US012478665B2

(12) United States Patent
Zhao et al.

(10) Patent No.: US 12,478,665 B2
(45) Date of Patent: Nov. 25, 2025

(54) CANCER VACCINE COMPOSITIONS AND METHODS FOR USING SAME TO PREVENT AND/OR TREAT CANCER

(71) Applicant: Dana-Farber Cancer Institute, Inc., Boston, MA (US)

(72) Inventors: Jean Zhao, Brookline, MA (US); Yunneng Tang, Brookline, MA (US); Xin Cheng, Brookline, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 954 days.

(21) Appl. No.: 17/626,263

(22) PCT Filed: Jul. 14, 2020

(86) PCT No.: PCT/US2020/041886

§ 371 (c)(1),
(2) Date: Jan. 11, 2022

(87) PCT Pub. No.: WO2021/015986

PCT Pub. Date: Jan. 28, 2021

(65) Prior Publication Data

US 2022/0265798 A1 Aug. 25, 2022

Related U.S. Application Data

(60) Provisional application No. 62/876,416, filed on Jul. 19, 2019.

(51) Int. Cl.
*A61K 39/00* (2006.01)

(52) U.S. Cl.
CPC .. *A61K 39/001134* (2018.08); *A61K 39/0011* (2013.01); *A61K 2039/5156* (2013.01); *A61K 2039/575* (2013.01); *A61K 2039/812* (2018.08)

(58) Field of Classification Search
CPC ...... A61K 39/001134; A61K 2039/575; A61K 38/1841; A61K 35/13; A61K 2039/5152; A61K 45/06; A61P 35/00
See application file for complete search history.

(56) References Cited

U.S. PATENT DOCUMENTS

| | | | |
|---|---|---|---|
| 2012/0114640 A1 | 5/2012 | Kulkarni et al. | |
| 2017/0334981 A1 | 11/2017 | Hansen et al. | |

FOREIGN PATENT DOCUMENTS

| | | | | |
|---|---|---|---|---|
| WO | WO-2008/086612 A1 | | 7/2008 | |
| WO | 2008/105978 | * | 9/2008 | ............ A61K 39/00 |
| WO | WO-2008/105978 A1 | | 9/2008 | |
| WO | WO-2010/129515 A1 | | 11/2010 | |
| WO | 2013/078392 | * | 5/2013 | ......... A61K 31/4184 |
| WO | WO-2019/084086 A1 | | 5/2019 | |
| WO | WO-2021/015986 A1 | | 1/2021 | |

OTHER PUBLICATIONS

Nemunaitis et al. Cancer Gene Ther. Aug. 2009; 16(8):620-4 (Year: 2009).*
Alexander, Heather. "Can You Prevent Cancer?" MD Anderson Cancer Center, Jan. 2020. Online. (Year: 2020).*
Extended European Search Report for EP Application No. 20844381.2 dated Jul. 21, 2023.
Bian et al., "Loss of TGF-[beta] signaling and PTEN promotes head and neck squamous cell carcinoma through cellular senescense evasion and cancer-related inflammation" Oncogene, vol. 31, No. 28: pp. 3322-3332 (2011).
Berrueta et al., "Stretching Reduces Tumor Growth in a Mouse Breast Cancer Model," Scientific Reports 8.1 (2018): 7864 (7 pages).
International Search Report and Written Opinion for International Application No. PCT/US2020/041886 dated Dec. 17, 2020.
Invitation to Pay Additional Fees for International Application No. PCT/US2020/041886 dated Oct. 5, 2020.

* cited by examiner

*Primary Examiner* — Jeffrey Stucker
*Assistant Examiner* — Sarah Cooper Patterson
(74) *Attorney, Agent, or Firm* — Foley Hoag LLP; DeAnn F. Smith

(57) ABSTRACT

The present invention is based, in part, on cancer vaccine compositions that comprise PTEN- and p53-deficient cancer cells with activated TGFβ-Smad/p63 signaling pathway, and methods for using same to prevent and/or treat cancer.

11 Claims, 46 Drawing Sheets

Specification includes a Sequence Listing.

CANCER VACCINE COMPOSITIONS AND METHODS FOR USING SAME TO PREVENT AND/OR TREAT CANCER

CROSS-REFERENCE TO RELATED APPLICATIONS

This application is the U.S. national phase of International Patent Application No. PCT/US2020/041886 filed on 14 Jul. 2020, which claims the benefit of priority to U.S. Provisional Application Ser. No. 62/876,416, filed on 19 Jul. 2019; the entire contents of each of said applications are incorporated herein in their entirety by this reference.

STATEMENT OF RIGHTS

This invention was made with government support under grant number P50 CA168504, CA233810, CA187918, and R35 CA210057 awarded by The National Institutes of Health. The government has certain rights in the invention.

SEQUENCE LISTING

The present specification makes reference to a Sequence Listing (submitted electronically as a .txt file named "DFS-27301 Sequence Listing" on Jan. 11, 2022). The .txt file was generated on Aug. 20, 2020 and is 1,038,512 bytes in size. The entire contents of the Sequence Listing are herein incorporated by reference.

BACKGROUND OF THE INVENTION

Transforming growth factor beta (TGFβ) is a pluripotent cytokine that plays critical roles in regulating embryo development, cell metabolism, tumor progression, and immune system homeostasis (David and Massague (2018) *Nat. Rev. Mol. Cell. Biol.* 19:419-435). TGFβ, upon binding to its receptors located on the cell membrane, regulates the expressions of its downstream genes in manners that can depend on Smads or be independent of Smads. TGFβ regulates cancer development and progression in a stage- and cell context-dependent manner (Morikawa et al. (2016) *Cold Spring Harb. Perspect. Biol.* 8:a021873; Prunier et al. (2019) *Trends Cancer* 5:66-78; Seoane and Gomis (2017) *Cold Spring Harb. Perspect. Biol.* 9: a022277). TGFβ suppresses tumorigenesis through the induction of cell growth arrest and apoptosis in pre-malignant cells. Silencing TGFβ signaling pathway promotes tumor formation in different mouse models (Cammareri et al. (2016) *Nat. Commun.* 7:12493; Yu et al. (2014) *Oncogene* 33:1538-1547; Cohen et al. (2009) *Cancer Res.* 69:3415-3424). Loss-of-function mutations in the TGFβ signaling pathway are also commonly found in various human cancers (Levy and Hill (2006) *Cytokine Growth Factor Rev.* 17:41-58). However, in the late stage of cancer, TGFβ promotes tumor metastasis and drug resistance. On one hand, due to accumulation of oncogenic mutations, the cancer cell itself overcomes growth arrest and apoptosis induced by TGFβ. TGFβ induces epithelial-to-mesenchymal transition (EMT) in the cancer cell, increases the sternness of the cancer cell, increases angiogenesis, and promotes drug resistance (Ahmadi et al. (2018) *J. Cell Physiol.* 234:12173-12187). On the other hand, TGFβ promotes CD4+ regulatory T cell (Treg), myleloid cell derived suppressor cell (MDSC), and M2 macrophage differentiation and thereby suppresses the host's anti-tumor immunity, which supports cancer growth and metastasis (Dahmani and Delisle (2018) *Cancers* (*Basel*) 10:194).

Since the TGFβ signaling pathway can act as both a tumor suppressor and a cancer promoter, the ability to harness TGFβ signaling pathway for desired therapeutic purposes remains a matter of significant debate. Thus, there is a great need in the art to identify anti-cancer therapies based on a better understanding of the role of TGFβ signaling pathway in cancer.

SUMMARY OF THE INVENTION

The present invention is based, at least in part, on the discovery that PTEN- and p53-deficient tumor cells bearing activated TGFβ-Smad/p63 signaling (e.g., treated with at least one TGFβ superfamily protein) failed to form tumors in immunocompetent hosts in a T cell-dependent manner. Administration of these tumor cells also provides protection to hosts from recurrent and metastatic tumor lesions. The cancer vaccine generated with these tumor cells advantageously overcomes recalcitrant obstacles in the field, such as lack of tumor specific antigen presentation, tumor heterogeneity and low immune infiltration, by eliciting a broad-spectrum immune response. It was demonstrated that these effects are mediated, at least in part, by activation of a Smad/p63 transcriptional complex in tumor cells, which regulates expression of multiple pathways that promote immune response and ultimately activation of cytotoxic T cells and immunological memory.

In one aspect, provided herein is a cancer vaccine comprising cancer cells, wherein the cancer cells are: (1) PTEN-deficient; (2) p53-deficient; and (3) modified to activate the TGFβ-Smad/p63 signaling pathway.

In another aspect, provided herein is a method of preventing occurrence of a cancer, delaying onset of a cancer, preventing reoccurrence of a cancer, and/or treating a cancer in a subject comprising administering to the subject a therapeutically effective amount of a cancer vaccine comprising cancer cells, wherein the cancer cells are: (1) PTEN-deficient; (2) p53-deficient; and (3) modified to activate the TGFβ-Smad/p63 signaling pathway, optionally wherein the subject is afflicted with a cancer. In one embodiment, the cancer cells are derived from a cancer that is the same type as the cancer treated with the cancer vaccine. In another embodiment, the cancer cells are derived from a cancer that is a different type from the cancer treated with the cancer vaccine. In still another embodiment, the cancer treated with the cancer vaccine is characterized by loss of PTEN, p53, and/or p110, optionally wherein the cancer further expresses Myc. In yet another embodiment, the cancer treated with the cancer vaccine has functional PTEN and/or p53, optionally wherein the cancer has a Kras activating mutation G12D. In another embodiment, the cancer vaccine is syngeneic or xenogeneic to the subject. In still another embodiment, the cancer vaccine is autologous, matched allogeneic, mismatched allogeneic, or congenic to the subject. In yet another embodiment, the cancer treated with the cancer vaccine is selected from the group consisting of breast, ovarian or brain cancer, e.g., a breast tumor, an ovarian tumor, or a brain tumor.

Numerous embodiments are further provided that can be applied to any aspect of the present invention described herein. For example, in one embodiment, the TGFβ-Smad/p63 signaling pathway is activated by contacting the cancer cells with at least one TGFβ superfamily protein. In another embodiment, the at least one TGFβ superfamily protein is selected from the group consisting of LAP, TGFβ1, TGFβ2, TGFβ3, TGFβ5, Activin A, Activin AB, Activin AC, Activin B, Activin C, C17ORF99, INHBA, INHBB, Inhibin, Inhibin A, Inhibin B, BMP-1/PCP, BMP-2, BMP-2/BMP-6 Heterodimer, BMP-2/BMP-7 Heterodimer, BMP-2a, BMP-3, BMP-3b/GDF-10, BMP-4, BMP-4/BMP-7 Heterodimer, BMP-5, BMP-6, BMP-7, BMP-8, BMP-8a, BMP-8b, BMP-9, BMP-10, BMP-15/GDF-9B, Decapentaplegic/DPP, Artemin, GDNF, Neurturin, Persephin, Lefty A, Lefty B, MIS/AMH, Nodal, and SCUBE3. In still another embodiment, the at least one TGFβ superfamily protein is selected from the group consisting of TGFβ1, TGFβ2, and TGFβ3. In yet another embodiment, the cancer cells are contacted with the TGFβ superfamily protein in vitro, in vivo, and/or ex vivo. For example, the cancer cells may be contacted with the TGFβ superfamily protein in vitro or ex vivo. In another embodiment, the cancer cells are administered to a subject, and the TGFβ superfamily protein is administered to the subject to thereby contact the cancer cells in vivo. In still another embodiment, the TGFβ superfamily protein is administered before, after, or concurrently with administration of the cancer cells. In yet another embodiment, the TGFβ-Smad/p63 signaling pathway is activated by increasing the copy number, amount, and/or activity of at least one biomarker listed in Table 1, and/or decreasing the copy number, amount, and/or activity of at least one biomarker listed in Table 2 in the cancer cells. For example, the copy number, amount, and/or activity of at least one biomarker listed in Table 1 may be increased by contacting the cancer cells with a nucleic acid molecule encoding at least one biomarker listed in Table 1 or fragment thereof, a polypeptide of at least one biomarker listed in Table 1 or fragment thereof, or a small molecule that binds to at least one biomarker listed in Table 1. In another embodiment, the TGFβ-Smad/p63 signaling pathway is activated by increasing nuclear localization of Smad2. In still another embodiment, the TGFβ-Smad/p63 signaling pathway is activated by increasing association of p63 and Smad2 in the nucleus of the cancer cells. In yet another embodiment, the copy number, amount, and/or activity of at least one biomarker listed in Table 2 is decreased by contacting the cancer cells with a small molecule inhibitor, CRISPR guide RNA (gRNA), RNA interfering agent, antisense oligonucleotide, peptide or peptidomimetic inhibitor, aptamer, antibody, and/or intrabody.

In yet another embodiment, the cancer cells are derived from a solid or hematological cancer. In another embodiment, the cancer cells are derived from a cancer cell line. In still another embodiment, the cancer cells are derived from primary cancer cells. In yet another embodiment, the cancer cells are breast cancer cells. In another embodiment, the cancer cells are derived from a triple-negative breast cancer (TNBC).

In still another embodiment, activation of TGFβ-Smad/p63 signaling pathway induces epithelial-to-mesenchymal (EMT) transition in the cancer cells. In yet another embodiment, activation of TGFβ-Smad/p63 signaling pathway upregulates the expression levels of ICOSL, PYCARD, SFN, PERP, RIPK3, CASP9, and/or SESN1 in the cancer cells. In another embodiment, activation of TGFβ-Smad/p63 signaling pathway downregulates the expression levels of KSR1, KSR1, EIF4EBP1, ITGA5, EMILIN1, CD200, and/or CSF1 in the cancer cells. In still another embodiment, the cancer cells are capable of activating co-cultured dendritic cells (DCs) in in vitro. In yet another embodiment, the cancer cells are capable of upregulating CD40, CD80, CD86, CD103, CD8, HLA-DR, MHC-II, and/or IL1-β in the co-cultured dendritic cells in vitro. In another embodiment, the cancer cells are capable of activating co-cultured T cells in the presence of DCs in vitro. In still another embodiment, the cancer cells are capable of increasing secretion of TNFα and/or IFNγ by the co-cultured T cells in the presence of DCs in vitro. In yet another embodiment, the cancer cells do not form a tumor in an immune-competent subject. In another embodiment, the cancer vaccine triggers cytotoxic T cell-mediated antitumor immunity. In still another embodiment, the cancer vaccine increases CD4+ T cells and CD8+ T cells in blood and/or tumor microenvironment. In yet another embodiment, the cancer vaccine increases TNFα- and INFγ-secreting CD4+ and CD8+ T cells in blood and/or tumor microenvironment. In another embodiment, the cancer vaccine upregulates expression of Icos, Klrc1, Il2rb, Pik3cd, H2-D1, Cc18, Ifng, Icosl, Il2ra, Cxcr3, Ccr7, Cxcl10, Cd74, H2-Ab1, Hspa1b, Cd45, Lifr, and/or Tnf in tumor tissues. In still another embodiment, the cancer vaccine increases the amount of tumor-infiltrating dendritic cells. In yet another embodiment, the cancer vaccine upregulates CD80, CD103, and/or MHC-II in tumor-associated DCs. In another embodiment, the cancer vaccine reduces the number of proliferating cells in a cancer and/or reduces the volume or size of a tumor comprising cancer cells. In still another embodiment, the cancer vaccine reduces the number of proliferating cells in a cancer and/or reduces the volume or size of a tumor comprising cancer cells at the primary site of immunization. In yet another embodiment, the cancer vaccine reduces the number of proliferating cells in a cancer and/or reduces the volume or size of a tumor comprising cancer cells in a tissue that is distal to the site of immunization. In another embodiment, the cancer vaccine induces a tumor-specific memory T cell response. In still another embodiment, the cancer vaccine increases the percentages of CD4+ central memory ($T_{CM}$) T cells and/or CD4+ effector memory ($T_{EM}$) T cells in a spleen and/or lymph nodes. In yet another embodiment, cancer vaccine increases the percentage of splenic CD8+ $T_{CM}$ cells. In another embodiment, cancer vaccine increases the percentage of CD8+ $T_{EM}$ cells in a spleen and/or lymph nodes. In still another embodiment, the cancer vaccine increases the amount of tumor infiltrating CD4+ T cells and/or CD8+ T cells. In yet another embodiment, the cancer vaccine increases the amount of tumor infiltrating CD4+ $T_{CM}$ cells and/or CD4+ $T_{EM}$ cells. In another embodiment, the cancer vaccine increases the amount of tumor infiltrating CD8+ $T_{CM}$ cells and/or CD8+ $T_{EM}$ cells. In still another embodiment, the cancer cells are non-replicative. In yet another embodiment, the cancer cells are non-replicative due to irradiation. In another embodiment, the irradiation is at a sub-lethal dose.

In still another embodiment, the cancer vaccine is administered to a subject in combination with an immunotherapy and/or cancer therapy, optionally wherein the immunotherapy and/or cancer therapy is administered before, after, or concurrently with the cancer vaccine. In yet another embodiment, the immunotherapy is cell-based. In another embodiment, the immunotherapy comprises a cancer vaccine and/or virus. In still another embodiment, the immunotherapy inhibits an immune checkpoint. In yet another embodiment, the immune checkpoint is selected from the group consisting of CTLA-4, PD-1, VISTA, B7-H2, B7-H3, PD-L1, B7-H4, B7-H6, ICOS, HVEM, PD-L2, CD160, gp49B, PIR-B, KIR family receptors, TIM-1, TIM-3, TIM-4, LAG-3, GITR, 4-IBB, OX-40, BTLA, SIRPalpha (CD47), CD48, 2B4 (CD244), B7.1, B7.2, ILT-2, ILT-4, TIGIT, HHLA2, butyrophilins, and A2aR. In another embodiment, the immune checkpoint is PD1, PD-L1, or CD47. In still another embodiment, the cancer therapy is selected from the group consisting of radiation, a radiosensitizer, and a chemotherapy.

In still another aspect, provided herein is a method of assessing the efficacy of the cancer vaccine for treating a subject afflicted with a cancer, comprising: a) detecting in a subject sample at a first point in time the number of proliferating cells in the cancer and/or the volume or size of a tumor comprising the cancer cells; b) repeating step a) during at least one subsequent point in time after administration of the cancer vaccine; and c) comparing the number of proliferating cells in the cancer and/or the volume or size of a tumor comprising the cancer cells detected in steps a) and b), wherein the absence of, or a significant decrease in number of proliferating cells in the cancer and/or the volume or size of a tumor comprising the cancer cells in the subsequent sample as compared to the number and/or the volume or size in the sample at the first point in time, indicates that the cancer vaccine treats cancer in the subject. In one embodiment, between the first point in time and the subsequent point in time, the subject has undergone treatment, completed treatment, and/or is in remission for the cancer. In another embodiment, the first and/or at least one subsequent sample is selected from the group consisting of ex vivo and in vivo samples. In still another embodiment, the first and/or at least one subsequent sample is a portion of a single sample or pooled samples obtained from the subject. In yet another embodiment, the sample comprises cells, serum, peripheral lymphoid organs, and/or intratumoral tissue obtained from the subject. In another embodiment, the method described herein further comprises determining responsiveness to the agent by measuring at least one criteria selected from the group consisting of clinical benefit rate, survival until mortality, pathological complete response, semi-quantitative measures of pathologic response, clinical complete remission, clinical partial remission, clinical stable disease, recurrence-free survival, metastasis free survival, disease free survival, circulating tumor cell decrease, circulating marker response, and RECIST criteria. In still another embodiment, the cancer vaccine is administered in a pharmaceutically acceptable formulation. In yet another embodiment, the step of administering occurs in vivo, ex vivo, or in vitro.

As described above, certain embodiments are applicable to any aspect of the present invention described herein. For example, in one embodiment, the cancer vaccine prevents recurrent and metastatic tumor lesions. In another embodiment, the cancer vaccine is administered to the subject intratumorally or subcutaneously. In still another embodiment, the subject is an animal model of the cancer, optionally wherein the animal model is a mouse model. In yet another embodiment, the subject is a mammal, optionally wherein the mammal is in remission for a cancer. In another embodiment, the mammal is a mouse or a human. For example, the mammal is a human.

BRIEF DESCRIPTION OF THE DRAWINGS

FIG. 1A shows the workflows for investigating the roles of TGFβ in a mouse model of TNBC derived from concurrent ablation of p53 (encoded by Trp53 in mice) and Pten (termed PP). FIG. 1B shows expression levels of EMT markers detected in PP and TGFβ-treated PP ($PP_T$) cells by real-time PCR. Data are shown as mean±s.e.m. *indicates P<0.05, *indicates P<0.001, indicates P<0.0001; n=4 for each group. FIG. 1**C shows in vivo growth of PP and $PP_T$ cells (n=10 per group). PP and TGFβ-treated PP ($PP_T$) tumor cells were injected into syngeneic FVB wild type mice.

FIG. 3A shows growth of PP and $PP_T$ cells in FVB wild type mice (n=10 per group). FIG. 3B shows growth of $PP_T$ tumor cells in FVB wild type mice treated with anti-CD3 or anti-IgG (n=10 per group). FIG. 3C shows a schematic diagram of the work flow for analyzing local and systemic antitumor immune response in syngeneic mice. Splenic, peripheral blood, and tumor infiltrating CD45+CD3+CD4+ T cells (FIGS. 3D-3F) and CD45+CD3+CD8+ T cells (FIGS. 3G-3I) were detected by flow cytometry. The proportions of TNFα- and IFN-γ-secreting CD4+(FIGS. 3E and 3F) and CD8+(FIGS. 3H and 3I) T cells in the spleen, blood, and tumor microenvironment are shown. Data are shown as mean±s.e.m. *indicates P<0.05, indicates P<0.01, *indicates P<0.001, ****indicates P<0.0001; n=5 for each group.

FIG. 4A shows relevant GO terms/KEGG pathways. FIG. 4B shows expression of some important targets from transcriptome data as verified by real-time PCR. Data are shown as mean s.e.m. *indicates P<0.05, indicates P<0.01, *indicates P<0.001, **indicates P<0.0001; n=5 for each group. FIG. 4C shows related gene interaction networks that positively regulate antitumor immunity. FIGS. 4D and 4E show the proportions of tumor-infiltrating CD45+CD11C+ DCs in PP and $PP_T$ 6-day tumor tissues as analyzed by flow cytometry (FIG. 4D). The expression of MHC-II, CD80, and CD103 were gated in DCs (FIG. 4E); n=5 for each group. FIG. 4F shows a schematic diagram of work flow for analyzing the effect of PP and $PP_T$ on DC and T cell activation. FIG. 4G shows detection of DC activation markers by flow cytometry; n=6 for each group, indicates P<0.0001. "Matched allogenic" immature DCs harvested from the bone marrow of syngeneic healthy FVB mice were incubated with PP or $PP_T$ cells. FIGS. 4H and 4I show determination of activation of CD4+(FIG. 4H) and CD8+(FIG. 4I) T cells by flow cytometry; n=6 per group. **indicates P<0.0001. T cells and DCs were co-cultured with or without tumor cells overnight.

FIGS. 5A and 5B show expression of MHC-II in CD45+ and CD45-cells in 6-day-old PP and $PP_T$ tumor tissues as analyzed by flow cytometry; n=5 for each group. **indicates P<0.0001. FIGS. 5C and 5D show expression of TNFα and IFN-γ in CD4+(FIG. 5C) and CD8+(FIG. 5**D) T cells as detected by flow cytometry; n=3 per group. T cells isolated from naïve mice were incubated with PP or $PP_T$ cells overnight.

FIG. 6A shows the Smad-related transcription factors network in $PP_T$ cell as calculated based on a customized mouse transcriptome profiling. The size and color of nodes indicate the value of reads per million (rpm) for indicated genes. "Smads" stands for Smad2, Smad3, and Smad4 complex. FIG. 6B shows growth of $PP_T$-scramble or $PP_T$-shTrp63 tumors in syngeneic mice; n=10 per group. FIG. 6C shows expression of MHC-II, CD80 and CD103 in DCs as detected by flow cytometry; n=4 per group. "Matched allogenic" immature DCs harvested from the bone marrow of syngeneic healthy FVB mice were co-cultured with $PP_T$-scramble or $PP_T$-shTrp63 cells.

FIG. 7A shows expression of p63 protein in PP and $PP_T$ cells. FIGS. 7B and 7C show cellular localization of Smad2 and p63 as analyzed by confocal microscopy (FIG. 7B) and western blotting (FIG. 7C). FIG. 7D shows protein-protein interaction for Smad2 and p63 as analyzed by co-immunoprecipitation assays.

FIG. 9A shows expression levels of p63 protein in human breast cancer cell lines. FIG. 9B shows that immature human DCs were incubated with human breast cancer cells, MCF7 or HCC1954, as indicated. Both MCF7T and HCC1954T were treated with TGFβ. FIGS. 9C-9E show expression of CD80, CD86 and CD103 in DCs by flow cytometry; n=4 per group; *indicates P<0.05, indicates P<0.01, *indicates P<0.001. FIG. 9F shows the relationships between TP63-Smad signature (PYCARD, RIPK3, CASP9, SESN1, and TP63 high; KSR1, EIF4EBP1, ITGA5, and EMILIN1 low) and patient survival according to the Curtis Breast dataset. ****indicates P<0.0001.

FIG. 12A shows a schematic diagram of the work flow for determining the efficacy of $PP_T$ immunization on PP tumor rejection. FIGS. 12B-12E show PP cells or PP tumor fragments were transplanted into control and $PP_T$-immunized mice. Tumor growth curves (FIGS. 12B and 12D; n=10 per group) and long-term survival of mice (FIGS. 12C and 12E; n=5 per group) are shown. FIGS. 12F and 12G show that PP tumor cells were injected into $PP_T$-immunized or control mice via tail vein injection. Lung metastatic nodules were examined after 4 weeks; n=5 mice per group, ****indicates P<0.0001.

FIG. 13A shows workflows for determining the memory in the TME. FIG. 13B shows the proportions of the tumor infiltrating CD4+ and CD8+ T cells in the CD45+ leukocytes of PP tumors transplaned into $PP_T$ immunized or control mice. FIG. 13C shows proportions of CD45+CD3+CD4+FOXP3-CD44+KLRG1-CD62L+ central memory T cells (CD4+ $T_{CM}$ cells), CD45+CD3+CD4+FOXP3-CD44+KLRG1+CD62L− effector memory T cells (CD4+ $T_{EM}$ cells). FIG. 13D shows proportions of CD45+CD3+CD8+FOXP3-CD44+KLRG1-CD62L+ central memory T cells (CD8+ $T_{CM}$ cells), and CD45+CD3+CD8+FOXP3-CD44+KLRG1+CD62L− effector memory T cells (CD8+ $T_{EM}$ cells). Analyses were done by flow cytometry. *P<0.05, *P<0.001, **P<0.0001; n=6 for each group.

FIG. 15A-FIG. 1511 show that $PP_T$ cells can be used as allogeneic vaccines against different types of cancers. Indicated tumor cell lines were injected into PBS or $PP_T$ cells vaccinated mice. The growth of PPA (FIG. 15A; a mouse breast cancer model characterized by triple loss of p53, PTEN, and P110α), C260 (FIG. 15C; a p53/PTEN double loss and Myc high mouse ovarian cancer model), D658 (FIG. 15E; a Kras mutated recurrent breast cancer cell line generated from a $PIK3CA^{H1047A}$ mouse model of breast cancer), and d333 (FIG. 15G; a brain tumor derived from p53 and PTEN double loss mouse) tumors were shown. n=10 for each group. The survival of mice transplanted with indicated tumors were also shown in FIGS. 15B, 15D, 15F, and 15H. n=5 per group.

Figure 21:
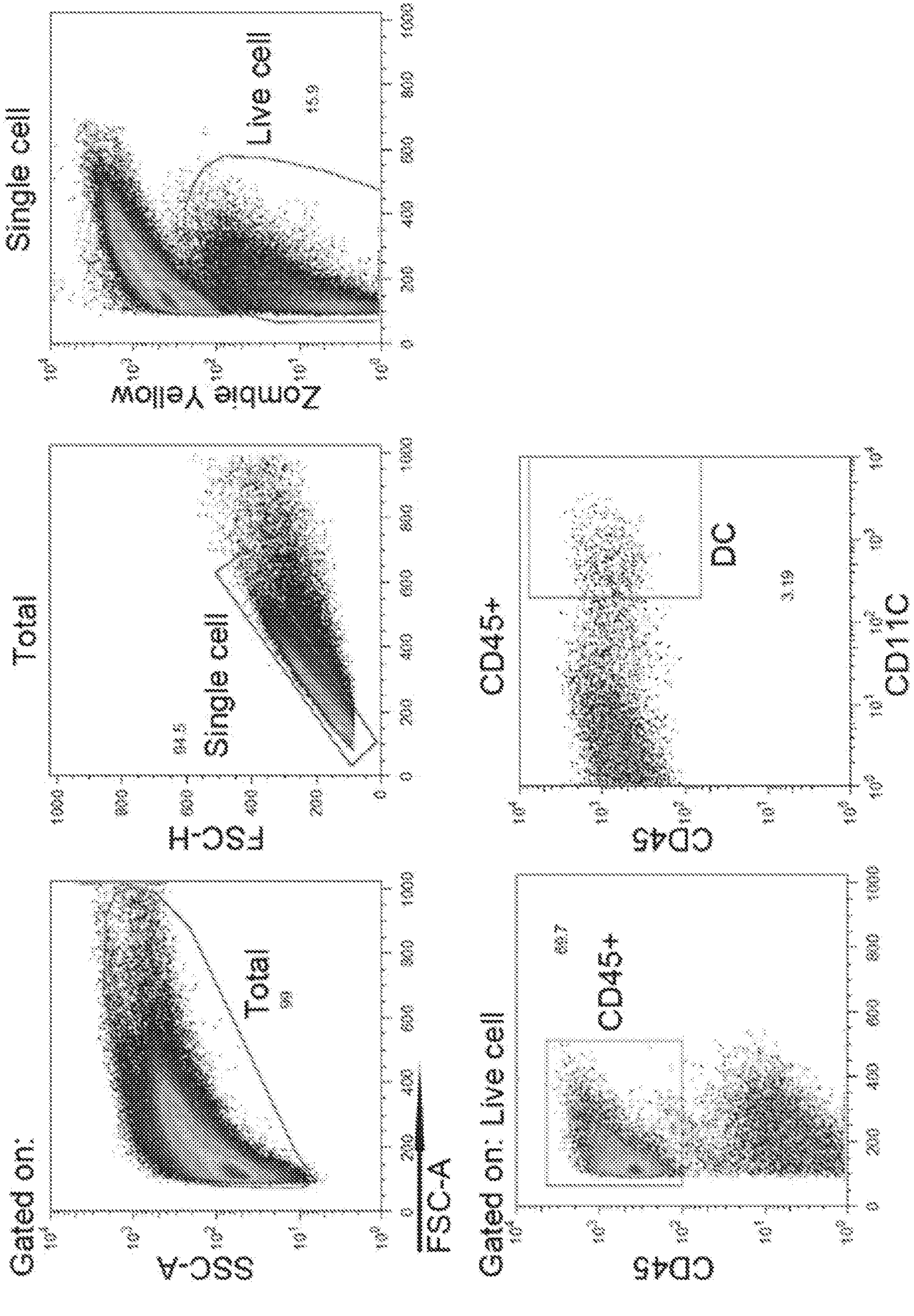

FIG. 21 shows gating strategy for tumor infiltrating dendritic cell. Flow cytometry gating for tumor infiltrating dendritic cell (DC) in order to examine the expressions of MHCII, CD80, and CD103 was shown.

For any figure showing a bar histogram, curve, or other data associated with a legend, the bars, curve, or other data presented from left to right for each indication correspond directly and in order to the boxes from top to bottom of the legend.

DETAILED DESCRIPTION OF THE INVENTION

It has been determined herein that PTEN- and p53-deficient tumor cells bearing activated TGFβ-Smad/p63 signaling (e.g., treated with at least one TGFβ superfamily protein) failed to form tumors in immunocompetent hosts in a T cell-dependent manner. For example, treatment of tumor cells derived from a syngeneic mouse breast tumor model driven by concurrent loss of p53 and Pten with TGFβ in vitro completely abrogated their ability to form tumors in immunocompetent mice in a T cell-dependent manner. It was also demonstrated that these cells triggered robust anti-tumor immunity via engagement and activation of dendritic cells (DCs), which in turn activated T cells to target tumor cells. In addition, it was found that p63 is a key co-factor for TGFβ/Smad-mediated transcription in response to TGFβ stimulation. For example, activation of the TGFβ-Smad/p63 axis upregulated transcriptional outputs that induce activation of multiple immune pathways, and these effects were abolished when either p63 or Smad2 was depleted. Moreover, administration of tumor cells bearing activated TGFβ-Smad/p63 signaling protect hosts from recurrent and metastatic tumor lesions through induction of long-term memory T cell responses. It was also found that the survivals of breast cancer patients were highly correlated with the TGFβ-Smad/p63 signatures. These results uncover a new molecular switch underlying the opposing effects of TGFβ in tumor development and provide a strategy for developing effective tumor vaccines through TGFβ-based reprogramming. Accordingly, compositions and methods for preventing and/or treating cancer using a cancer vaccine that comprises cancer cells that are (1) Pten-deficient, (2) p53-deficient, and (3) modified to active TGFβ-Smad/p63 signaling pathway, are provided. In addition, methods of assessing the efficacy of the cancer vaccine for preventing and/or treating cancer is also provided.

I. Definitions

The articles "a" and "an" are used herein to refer to one or to more than one (i.e. to at least one) of the grammatical object of the article. By way of example, "an element" means one element or more than one element.

The term "administering" is intended to include routes of administration which allow an agent to perform its intended function. Examples of routes of administration for treatment of a body which can be used include injection (subcutaneous, intravenous, parenteral, intraperitoneal, intrathecal, etc.), oral, inhalation, and transdermal routes. The injection can be bolus injections or can be continuous infusion. Depending on the route of administration, the agent can be coated with or disposed in a selected material to protect it from natural conditions which may detrimentally affect its ability to perform its intended function. The agent may be administered alone, or in conjunction with a pharmaceutically acceptable carrier. The agent also may be administered as a prodrug, which is converted to its active form in vivo.

The term "altered amount" or "altered level" refers to increased or decreased copy number (e.g., germline and/or somatic) of a biomarker nucleic acid, e.g., increased or decreased expression level in a cancer sample, as compared to the expression level or copy number of the biomarker nucleic acid in a control sample. The term "altered amount" of a biomarker also includes an increased or decreased protein level of a biomarker protein in a sample, e.g., a cancer sample, as compared to the corresponding protein level in a normal, control sample. Furthermore, an altered amount of a biomarker protein may be determined by detecting posttranslational modification such as methylation status of the marker, which may affect the expression or activity of the biomarker protein.

The amount of a biomarker in a subject is "significantly" higher or lower than the normal amount of the biomarker, if the amount of the biomarker is greater or less, respectively, than the normal level by an amount greater than the standard error of the assay employed to assess amount, and preferably at least 20%, 30%, 40%, 50%, 60%, 70%, 80%, 90%, 100%, 150%, 200%, 300%, 350%, 400%, 500%, 600%, 700%, 800%, 900%, 1000% or than that amount. Alternately, the amount of the biomarker in the subject can be considered "significantly" higher or lower than the normal amount if the amount is at least about two, and preferably at least about three, four, or five times, higher or lower, respectively, than the normal amount of the biomarker. Such "significance" can also be applied to any other measured parameter described herein, such as for expression, inhibition, cytotoxicity, cell growth, and the like.

The term "altered level of expression" of a biomarker refers to an expression level or copy number of the biomarker in a test sample, e.g., a sample derived from a patient suffering from cancer, that is greater or less than the standard error of the assay employed to assess expression or copy number, and is preferably at least twice, and more preferably three, four, five or ten or more times the expression level or copy number of the biomarker in a control sample (e.g., sample from a healthy subjects not having the associated disease) and preferably, the average expression level or copy number of the biomarker in several control samples. The altered level of expression is greater or less than the standard error of the assay employed to assess expression or copy number, and is preferably at least 20%, 30%, 40%, 50%, 60%, 70%, 80%, 90%, 100%, 150%, 200%, 300%, 350%, 400%, 500%, 600%, 700%, 800%, 900%, 1000% or more times the expression level or copy number of the biomarker in a control sample (e.g., sample from a healthy subjects not having the associated disease) and preferably, the average expression level or copy number of the biomarker in several control samples. In some embodiments, the level of the biomarker refers to the level of the biomarker itself, the level of a modified biomarker (e.g., phosphorylated biomarker), or to the level of a biomarker relative to another measured variable, such as a control (e.g., phosphorylated biomarker relative to an unphosphorylated biomarker).

The term "altered activity" of a biomarker refers to an activity of the biomarker which is increased or decreased in a disease state, e.g., in a cancer sample, as compared to the activity of the biomarker in a normal, control sample. Altered activity of the biomarker may be the result of, for example, altered expression of the biomarker, altered protein level of the biomarker, altered structure of the biomarker, or, e.g., an altered interaction with other proteins involved in the same or different pathway as the biomarker or altered interaction with transcriptional activators or inhibitors.

The term "altered structure" of a biomarker refers to the presence of mutations or allelic variants within a biomarker nucleic acid or protein, e.g., mutations which affect expression or activity of the biomarker nucleic acid or protein, as compared to the normal or wild-type gene or protein. For example, mutations include, but are not limited to substitutions, deletions, or addition mutations. Mutations may be present in the coding or non-coding region of the biomarker nucleic acid.

Unless otherwise specified here within, the terms "antibody" and "antibodies" broadly encompass naturally-occurring forms of antibodies (e.g. IgG, IgA, IgM, IgE) and recombinant antibodies, such as single-chain antibodies, chimeric and humanized antibodies and multi-specific antibodies, as well as fragments and derivatives of all of the foregoing, which fragments and derivatives have at least an antigenic binding site. Antibody derivatives may comprise a protein or chemical moiety conjugated to an antibody.

In addition, intrabodies are well-known antigen-binding molecules having the characteristic of antibodies, but that are capable of being expressed within cells in order to bind and/or inhibit intracellular targets of interest (Chen et al. (1994) *Human Gene Ther.* 5:595-601). Methods are well-known in the art for adapting antibodies to target (e.g., inhibit) intracellular moieties, such as the use of single-chain antibodies (scFvs), modification of immunoglobulin VL domains for hyperstability, modification of antibodies to resist the reducing intracellular environment, generating fusion proteins that increase intracellular stability and/or modulate intracellular localization, and the like. Intracellular antibodies can also be introduced and expressed in one or more cells, tissues or organs of a multicellular organism, for example for prophylactic and/or therapeutic purposes (e.g., as a gene therapy) (see, at least PCT Publs. WO 08/020079, WO 94/02610, WO 95/22618, and WO 03/014960; U.S. Pat. No. 7,004,940; Cattaneo and Biocca (1997) *Intracellular Antibodies: Development and Applications* (Landes and Springer-Verlag publs.); Kontermann (2004) *Methods* 34:163-170; Cohen et al. (1998) *Oncogene* 17:2445-2456; Auf der Maur et al. (2001) *FEBS Lett.* 508:407-412; Shaki-Loewenstein et al. (2005) *J. Immunol. Meth.* 303:19-39).

The term "antibody" as used herein also includes an "antigen-binding portion" of an antibody (or simply "antibody portion"). The term "antigen-binding portion", as used herein, refers to one or more fragments of an antibody that retain the ability to specifically bind to an antigen (e.g., a biomarker polypeptide or fragment thereof). It has been shown that the antigen-binding function of an antibody can be performed by fragments of a full-length antibody. Examples of binding fragments encompassed within the term "antigen-binding portion" of an antibody include (i) a Fab fragment, a monovalent fragment consisting of the VL, VH, CL and CH1 domains; (ii) a $F(ab')_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) *Nature* 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent polypeptides (known as single chain Fv (scFv); see e.g., Bird et al. (1988) *Science* 242:423-426; and Huston et al. (1988) *Proc. Natl. Acad. Sci. USA* 85:5879-5883; and Osbourn et al. 1998, Nature Biotechnology 16: 778). Such single chain antibodies are also intended to be encompassed within the term "antigen-binding portion" of an antibody. Any VH and VL sequences of specific scFv can be linked to human immunoglobulin constant region cDNA or genomic sequences, in order to generate expression vectors encoding complete IgG polypeptides or other isotypes. VH and VL can also be used in the generation of Fab, Fv or other fragments of immunoglobulins using either protein chemistry or recombinant DNA technology. Other forms of single chain antibodies, such as diabodies are also encompassed. Diabodies are bivalent, bispecific antibodies in which VH and VL domains are expressed on a single polypeptide chain, but using a linker that is too short to allow for pairing between the two domains on the same chain, thereby forcing the domains to pair with complementary domains of another chain and creating two antigen binding sites (see e.g., Holliger et al. (1993) *Proc. Natl. Acad. Sci. U.S.A.* 90:6444-6448; Poljak et al. (1994) *Structure* 2:1121-1123).

Still further, an antibody or antigen-binding portion thereof may be part of larger immunoadhesion polypeptides, formed by covalent or noncovalent association of the antibody or antibody portion with one or more other proteins or peptides. Examples of such immunoadhesion polypeptides include use of the streptavidin core region to make a tetrameric scFv polypeptide (Kipriyanov et al. (1995) *Human Antibodies and Hybridomas* 6:93-101) and use of a cysteine residue, biomarker peptide and a C-terminal polyhistidine tag to make bivalent and biotinylated scFv polypeptides (Kipriyanov et al. (1994) *Mol. Immunol.* 31:1047-1058). Antibody portions, such as Fab and $F(ab')_2$ fragments, can be prepared from whole antibodies using conventional techniques, such as papain or pepsin digestion, respectively, of whole antibodies. Moreover, antibodies, antibody portions and immunoadhesion polypeptides can be obtained using standard recombinant DNA techniques, as described herein.

Antibodies may be polyclonal or monoclonal; xenogeneic, allogeneic, or syngeneic; or modified forms thereof (e.g. humanized, chimeric, etc.). Antibodies may also be fully human. Preferably, antibodies of the invention bind specifically or substantially specifically to a biomarker polypeptide or fragment thereof. The terms "monoclonal antibodies" and "monoclonal antibody composition", as used herein, refer to a population of antibody polypeptides that contain only one species of an antigen binding site capable of immunoreacting with a particular epitope of an antigen, whereas the term "polyclonal antibodies" and "polyclonal antibody composition" refer to a population of antibody polypeptides that contain multiple species of antigen binding sites capable of interacting with a particular antigen. A monoclonal antibody composition typically displays a single binding affinity for a particular antigen with which it immunoreacts.

Antibodies may also be "humanized," which is intended to include antibodies made by a non-human cell having variable and constant regions which have been altered to more closely resemble antibodies that would be made by a human cell. For example, by altering the non-human antibody amino acid sequence to incorporate amino acids found in human germline immunoglobulin sequences. The humanized antibodies of the invention may include amino acid residues not encoded by human germline immunoglobulin sequences (e.g., mutations introduced by random or site-specific mutagenesis in vitro or by somatic mutation in vivo), for example in the CDRs. The term "humanized antibody", as used herein, also includes antibodies in which CDR sequences derived from the germline of another mammalian species, have been grafted onto human framework sequences.

The term "biomarker" refers to a measurable entity of the present invention that has been determined to be predictive of cancer therapy effects. Biomarkers can include, without limitation, nucleic acids (e.g., genomic nucleic acids and/or transcribed nucleic acids) and proteins. Many biomarkers are also useful as therapeutic targets.

A "blocking" antibody or an antibody "antagonist" is one which inhibits or reduces at least one biological activity of the antigen(s) it binds. In certain embodiments, the blocking antibodies or antagonist antibodies or fragments thereof described herein substantially or completely inhibit a given biological activity of the antigen(s).

The term "body fluid" refers to fluids that are excreted or secreted from the body as well as fluids that are normally not (e.g. amniotic fluid, aqueous humor, bile, blood and blood plasma, cerebrospinal fluid, cerumen and earwax, cowper's fluid or pre-ejaculatory fluid, chyle, chyme, stool, female ejaculate, interstitial fluid, intracellular fluid, lymph, menses, breast milk, mucus, pleural fluid, pus, saliva, sebum, semen, serum, sweat, synovial fluid, tears, urine, vaginal lubrication, vitreous humor, vomit).

The terms "cancer" or "tumor" or "hyperproliferative" refer to the presence of cells possessing characteristics typical of cancer-causing cells, such as uncontrolled proliferation, immortality, metastatic potential, rapid growth and proliferation rate, and certain characteristic morphological features.

Cancer cells are often in the form of a tumor, but such cells may exist alone within an animal, or may be a non-tumorigenic cancer cell, such as a leukemia cell. As used herein, the term "cancer" includes premalignant as well as malignant cancers. Cancers include, but are not limited to, B cell cancer, e.g., multiple myeloma, Waldenström's macroglobulinemia, the heavy chain diseases, such as, for example, alpha chain disease, gamma chain disease, and mu chain disease, benign monoclonal gammopathy, and immunocytic amyloidosis, melanomas, breast cancer, lung cancer, bronchus cancer, colorectal cancer, prostate cancer, pancreatic cancer, stomach cancer, ovarian cancer, urinary bladder cancer, brain or central nervous system cancer, peripheral nervous system cancer, esophageal cancer, cervical cancer, uterine or endometrial cancer, cancer of the oral cavity or pharynx, liver cancer, kidney cancer, testicular cancer, biliary tract cancer, small bowel or appendix cancer, salivary gland cancer, thyroid gland cancer, adrenal gland cancer, osteosarcoma, chondrosarcoma, cancer of hematologic tissues, and the like. Other non-limiting examples of types of cancers applicable to the methods encompassed by the present invention include human sarcomas and carcinomas, e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, colorectal cancer, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, liver cancer, choriocarcinoma, seminoma, embryonal carcinoma, Wilms' tumor, cervical cancer, bone cancer, brain tumor, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma; leukemias, e.g., acute lymphocytic leukemia and acute myelocytic leukemia (myeloblastic, promyelocytic, myelomonocytic, monocytic and erythroleukemia); chronic leukemia (chronic myelocytic (granulocytic) leukemia and chronic lymphocytic leukemia); and polycythemia vera, lymphoma (Hodgkin's disease and non-Hodgkin's disease), multiple myeloma, Waldenstrom's macroglobulinemia, and heavy chain disease. In some embodiments, cancers are epithlelial in nature and include but are not limited to, bladder cancer, breast cancer, cervical cancer, colon cancer, gynecologic cancers, renal cancer, laryngeal cancer, lung cancer, oral cancer, head and neck cancer, ovarian cancer, pancreatic cancer, prostate cancer, or skin cancer. In other embodiments, the cancer is breast cancer, prostate cancer, lung cancer, or colon cancer. In still other embodiments, the epithelial cancer is non-small-cell lung cancer, nonpapillary renal cell carcinoma, cervical carcinoma, ovarian carcinoma (e.g., serous ovarian carcinoma), or breast carcinoma. The epithelial cancers may be characterized in various other ways including, but not limited to, serous, endometrioid, mucinous, clear cell, Brenner, or undifferentiated.

The term "coding region" refers to regions of a nucleotide sequence comprising codons which are translated into amino acid residues, whereas the term "noncoding region" refers to regions of a nucleotide sequence that are not translated into amino acids (e.g., 5' and 3' untranslated regions).

The term "complementary" refers to the broad concept of sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. Preferably, the first region comprises a first portion and the second region comprises a second portion, whereby, when the first and second portions are arranged in an antiparallel fashion, at least about 50%, and preferably at least about 75%, at least about 90%, or at least about 95% of the nucleotide residues of the first portion are capable of base pairing with nucleotide residues in the second portion. More preferably, all nucleotide residues of the first portion are capable of base pairing with nucleotide residues in the second portion.

The terms "conjoint therapy" and "combination therapy," as used herein, refer to the administration of two or more therapeutic substances. The different agents comprising the combination therapy may be administered concomitant with, prior to, or following the administration of one or more therapeutic agents.

The term "control" refers to any reference standard suitable to provide a comparison to the expression products in the test sample. In one embodiment, the control comprises obtaining a "control sample" from which expression product levels are detected and compared to the expression product levels from the test sample. Such a control sample may comprise any suitable sample, including but not limited to a sample from a control cancer patient (can be stored sample or previous sample measurement) with a known outcome; normal tissue or cells isolated from a subject, such as a normal patient or the cancer patient, cultured primary cells/tissues isolated from a subject such as a normal subject or the cancer patient, adjacent normal cells/tissues obtained from the same organ or body location of the cancer patient, a tissue or cell sample isolated from a normal subject, or a primary cells/tissues obtained from a depository. In another preferred embodiment, the control may comprise a reference standard expression product level from any suitable source, including but not limited to housekeeping genes, an expression product level range from normal tissue (or other previously analyzed control sample), a previously determined expression product level range within a test sample from a group of patients, or a set of patients with a certain outcome (for example, survival for one, two, three, four years, etc.) or receiving a certain treatment (for example, standard of care cancer therapy). It will be understood by those of skill in the art that such control samples and reference standard expression product levels can be used in combination as controls in the methods of the present invention. In one embodiment, the control may comprise normal or non-cancerous cell/tissue sample. In another preferred embodiment, the control may comprise an expression level for a set of patients, such as a set of cancer patients, or for a set of cancer patients receiving a certain treatment, or for a set of patients with one outcome versus another outcome. In the former case, the specific expression product level of each patient can be assigned to a percentile level of expression, or expressed as either higher or lower than the mean or average of the reference standard expression level. In another preferred embodiment, the control may comprise normal cells, cells from patients treated with combination chemotherapy, and cells from patients having benign cancer. In another embodiment, the control may also comprise a measured value for example, average level of expression of a particular gene in a population compared to the level of expression of a housekeeping gene in the same population. Such a population may comprise normal subjects, cancer patients who have not undergone any treatment (i.e., treatment naive), cancer patients undergoing standard of care therapy, or patients having benign cancer. In another preferred embodiment, the control comprises a ratio transformation of expression product levels, including but not limited to determining a ratio of expression product levels of two genes in the test sample and comparing it to any suitable ratio of the same two genes in a reference standard; determining expression product levels of the two or more genes in the test sample and determining a difference in expression product levels in any suitable control; and determining expression product levels of the two or more genes in the test sample, normalizing their expression to expression of housekeeping genes in the test sample, and comparing to any suitable control. In particularly preferred embodiments, the control comprises a control sample which is of the same lineage and/or type as the test sample. In another embodiment, the control may comprise expression product levels grouped as percentiles within or based on a set of patient samples, such as all patients with cancer. In one embodiment a control expression product level is established wherein higher or lower levels of expression product relative to, for instance, a particular percentile, are used as the basis for predicting outcome. In another preferred embodiment, a control expression product level is established using expression product levels from cancer control patients with a known outcome, and the expression product levels from the test sample are compared to the control expression product level as the basis for predicting outcome. As demonstrated by the data below, the methods of the invention are not limited to use of a specific cut-point in comparing the level of expression product in the test sample to the control.

The "copy number" of a biomarker nucleic acid refers to the number of DNA sequences in a cell (e.g., germline and/or somatic) encoding a particular gene product. Generally, for a given gene, a mammal has two copies of each gene. The copy number can be increased, however, by gene amplification or duplication, or reduced by deletion. For example, germline copy number changes include changes at one or more genomic loci, wherein said one or more genomic loci are not accounted for by the number of copies in the normal complement of germline copies in a control (e.g., the normal copy number in germline DNA for the same species as that from which the specific germline DNA and corresponding copy number were determined). Somatic copy number changes include changes at one or more genomic loci, wherein said one or more genomic loci are not accounted for by the number of copies in germline DNA of a control (e.g., copy number in germline DNA for the same subject as that from which the somatic DNA and corresponding copy number were determined).

The term "immune cell" refers to cells that play a role in the immune response. Immune cells are of hematopoietic origin, and include lymphocytes, such as B cells and T cells; natural killer cells; myeloid cells, such as monocytes, macrophages, eosinophils, mast cells, basophils, and granulocytes.

Macrophages (and their precursors, monocytes) are the 'big eaters' of the immune system. These cells reside in every tissue of the body, albeit in different guises, such as microglia, Kupffer cells and osteoclasts, where they engulf apoptotic cells and pathogens and produce immune effector molecules. Upon tissue damage or infection, monocytes are rapidly recruited to the tissue, where they differentiate into tissue macrophages. Macrophages are remarkably plastic and can change their functional phenotype depending on the environmental cues they receive. Through their ability to clear pathogens and instruct other immune cells, these cells have a central role in protecting the host but also contribute to the pathogenesis of inflammatory and degenerative diseases. Macrophages that encourage inflammation are called M1 macrophages, whereas those that decrease inflammation and encourage tissue repair are called M2 macrophages. M1 macrophages are activated by LPS and IFN-gamma, and secrete high levels of IL-12 and low levels of IL-10. M2 is the phenotype of resident tissue macrophages, and can be further elevated by IL-4. M2 macrophages produce high levels of IL-10, TGFβ and low levels of IL-12. Tumor-associated macrophages are mainly of the M2 phenotype, and seem to actively promote tumor growth.

Myeloid derived suppressor cells (MDSCs) are an intrinsic part of the myeloid cell lineage and are a heterogeneous population comprised of myeloid cell progenitors and precursors of granulocytes, macrophages and dendritic cells. MDSCs are defined by their myeloid origin, immature state and ability to potently suppress T cell responses. They regulate immune responses and tissue repair in healthy individuals and the population rapidly expands during inflammation, infection and cancer. MDSC are one of the major components of the tumor microenvironment. The main feature of these cells is their potent immune suppressive activity. MDSC are generated in the bone marrow and, in tumor-bearing hosts, migrate to peripheral lymphoid organs and the tumor to contribute to the formation of the tumor microenvironment. This process is controlled by a set of defined chemokines, many of which are upregulated in cancer. Hypoxia appears to have a critical role in the regulation of MDSC differentiation and function in tumors. Therapeutic strategies are now being developed to target MDSCs to promote antitumour immune responses or to inhibit immune responses in the setting of autoimmune disease or transplant rejection.

Dendritic cells (DCs) are professional antigen-presenting cells located in the skin, mucosa and lymphoid tissues. Their main function is to process antigens and present them to T cells to promote immunity to foreign antigens and tolerance to self antigens. They also secrete cytokines to regulate immune responses.

Conventional T cells, also known as Tconv or Teffs, have effector functions (e.g., cytokine secretion, cytotoxic activity, anti-self-recognization, and the like) to increase immune responses by virtue of their expression of one or more T cell receptors. Tcons or Teffs are generally defined as any T cell population that is not a Treg and include, for example, naïve T cells, activated T cells, memory T cells, resting Tcons, or Tcons that have differentiated toward, for example, the Th1 or Th2 lineages. In some embodiments, Teffs are a subset of non-Treg T cells. In some embodiments, Teffs are CD4+ Teffs or CD8+ Teffs, such as CD4+ helper T lymphocytes (e.g., Th0, Th1, Tfh, or Th17) and CD8+ cytotoxic T lymphocytes. As described further herein, cytotoxic T cells are CD8+ T lymphocytes. "Naïve Tcons" are $CD4^+$ T cells that have differentiated in bone marrow, and successfully underwent a positive and negative processes of central selection in a thymus, but have not yet been activated by exposure to an antigen. Naïve Tcons are commonly characterized by surface expression of L-selectin (CD62L), absence of activation markers such as CD25, CD44 or CD69, and absence of memory markers such as CD45RO. Naïve Tcons are therefore believed to be quiescent and non-dividing, requiring interleukin-7 (IL-7) and interleukin-15 (IL-15) for homeostatic survival (see, at least WO 2010/101870). The presence and activity of such cells are undesired in the context of suppressing immune responses. Unlike Tregs, Tcons are not anergic and can proliferate in response to antigen-based T cell receptor activation (Lechler et al. (2001) *Philos. Trans. R. Soc. Lond. Biol. Sci.* 356:625-637). In tumors, exhausted cells can present hallmarks of anergy.

The term "immunotherapy" or "immunotherapies" refer to any treatment that uses certain parts of a subject's immune system to fight diseases such as cancer. The subject's own immune system is stimulated (or suppressed), with or without administration of one or more agent for that purpose. Immunotherapies that are designed to elicit or amplify an immune response are referred to as "activation immunotherapies." Immunotherapies that are designed to reduce or suppress an immune response are referred to as "suppression immunotherapies." Any agent believed to have an immune system effect on the genetically modified transplanted cancer cells can be assayed to determine whether the agent is an immunotherapy and the effect that a given genetic modification has on the modulation of immune response. In some embodiments, the immunotherapy is cancer cell-specific. In some embodiments, immunotherapy can be "untargeted," which refers to administration of agents that do not selectively interact with immune system cells, yet modulates immune system function. Representative examples of untargeted therapies include, without limitation, chemotherapy, gene therapy, and radiation therapy.

Immunotherapy is one form of targeted therapy that may comprise, for example, the use of cancer vaccines and/or sensitized antigen presenting cells. For example, an oncolytic virus is a virus that is able to infect and lyse cancer cells, while leaving normal cells unharmed, making them potentially useful in cancer therapy. Replication of oncolytic viruses both facilitates tumor cell destruction and also produces dose amplification at the tumor site. They may also act as vectors for anticancer genes, allowing them to be specifically delivered to the tumor site. The immunotherapy can involve passive immunity for short-term protection of a host, achieved by the administration of pre-formed antibody directed against a cancer antigen or disease antigen (e.g., administration of a monoclonal antibody, optionally linked to a chemotherapeutic agent or toxin, to a tumor antigen). For example, anti-VEGF and mTOR inhibitors are known to be effective in treating renal cell carcinoma. Immunotherapy can also focus on using the cytotoxic lymphocyte-recognized epitopes of cancer cell lines. Alternatively, antisense polynucleotides, ribozymes, RNA interference molecules, triple helix polynucleotides and the like, can be used to selectively modulate biomolecules that are linked to the initiation, progression, and/or pathology of a tumor or cancer.

Immunotherapy can involve passive immunity for short-term protection of a host, achieved by the administration of pre-formed antibody directed against a cancer antigen or disease antigen (e.g., administration of a monoclonal antibody, optionally linked to a chemotherapeutic agent or toxin, to a tumor antigen). Immunotherapy can also focus on using the cytotoxic lymphocyte-recognized epitopes of cancer cell lines. Alternatively, antisense polynucleotides, ribozymes, RNA interference molecules, triple helix polynucleotides and the like, can be used to selectively modulate biomolecules that are linked to the initiation, progression, and/or pathology of a tumor or cancer.

In some embodiments, immunotherapy comprises inhibitors of one or more immune checkpoints. The term "immune checkpoint" refers to a group of molecules on the cell surface of CD4+ and/or CD8+ T cells that fine-tune immune responses by down-modulating or inhibiting an anti-tumor immune response. Immune checkpoint proteins are well-known in the art and include, without limitation, CTLA-4, PD-1, VISTA, B7-H2, B7-H3, PD-L1, B7-H4, B7-H6, ICOS, HVEM, PD-L2, CD160, gp49B, PIR-B, KIR family receptors, TIM-1, TIM-3, TIM-4, LAG-3, GITR, 4-IBB, OX-40, BTLA, SIRPalpha (CD47), CD48, 2B4 (CD244), B7.1, B7.2, ILT-2, ILT-4, TIGIT, HHLA2, butyrophilins, and A2aR (see, for example, WO 2012/177624). The term further encompasses biologically active protein fragment, as well as nucleic acids encoding full-length immune checkpoint proteins and biologically active protein fragments thereof. In some embodiment, the term further encompasses any fragment according to homology descriptions provided herein. In one embodiment, the immune checkpoint is PD-1.

"Anti-immune checkpoint therapy" refers to the use of agents that inhibit immune checkpoint nucleic acids and/or proteins. Inhibition of one or more immune checkpoints can block or otherwise neutralize inhibitory signaling to thereby upregulate an immune response in order to more efficaciously treat cancer. Exemplary agents useful for inhibiting immune checkpoints include antibodies, small molecules, peptides, peptidomimetics, natural ligands, and derivatives of natural ligands, that can either bind and/or inactivate or inhibit immune checkpoint proteins, or fragments thereof; as well as RNA interference, antisense, nucleic acid aptamers, etc. that can downregulate the expression and/or activity of immune checkpoint nucleic acids, or fragments thereof. Exemplary agents for upregulating an immune response include antibodies against one or more immune checkpoint proteins block the interaction between the proteins and its natural receptor(s); a non-activating form of one or more immune checkpoint proteins (e.g., a dominant negative polypeptide); small molecules or peptides that block the interaction between one or more immune checkpoint proteins and its natural receptor(s); fusion proteins (e.g. the extracellular portion of an immune checkpoint inhibition protein fused to the Fc portion of an antibody or immunoglobulin) that bind to its natural receptor(s); nucleic acid molecules that block immune checkpoint nucleic acid transcription or translation; and the like. Such agents can directly block the interaction between the one or more immune checkpoints and its natural receptor(s) (e.g., antibodies) to prevent inhibitory signaling and upregulate an immune response. Alternatively, agents can indirectly block the interaction between one or more immune checkpoint proteins and its natural receptor(s) to prevent inhibitory signaling and upregulate an immune response. For example, a soluble version of an immune checkpoint protein ligand such as a stabilized extracellular domain can binding to its receptor to indirectly reduce the effective concentration of the receptor to bind to an appropriate ligand. In one embodiment, anti-PD-1 antibodies, anti-PD-L1 antibodies, and/or anti-PD-L2 antibodies, either alone or in combination, are used to inhibit immune checkpoints. These embodiments are also applicable to specific therapy against particular immune checkpoints, such as the PD-1 pathway (e.g., anti-PD-1 pathway therapy, otherwise known as PD-1 pathway inhibitor therapy).

The term "immune response" includes T cell mediated and/or B cell mediated immune responses. Exemplary immune responses include T cell responses, e.g., cytokine production and cellular cytotoxicity. In addition, the term immune response includes immune responses that are indirectly effected by T cell activation, e.g., antibody production (humoral responses) and activation of cytokine responsive cells, e.g., macrophages.

The term "immunotherapeutic agent" can include any molecule, peptide, antibody or other agent which can stimulate a host immune system to generate an immune response to a tumor or cancer in the subject. Various immunotherapeutic agents are useful in the compositions and methods described herein.

The term "inhibit" includes decreasing, reducing, limiting, and/or blocking, of, for example a particular action, function, and/or interaction. In some embodiments, the interaction between two molecules is "inhibited" if the interaction is reduced, blocked, disrupted or destabilized.

In some embodiments, cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

The term "interaction", when referring to an interaction between two molecules, refers to the physical contact (e.g., binding) of the molecules with one another. Generally, such an interaction results in an activity (which produces a biological effect) of one or both of said molecules.

An "isolated protein" refers to a protein that is substantially free of other proteins, cellular material, separation medium, and culture medium when isolated from cells or produced by recombinant DNA techniques, or chemical precursors or other chemicals when chemically synthesized. An "isolated" or "purified" protein or biologically active portion thereof is substantially free of cellular material or other contaminating proteins from the cell or tissue source from which the antibody, polypeptide, peptide or fusion protein is derived, or substantially free from chemical precursors or other chemicals when chemically synthesized. The language "substantially free of cellular material" includes preparations of a biomarker polypeptide or fragment thereof, in which the protein is separated from cellular components of the cells from which it is isolated or recombinantly produced. In one embodiment, the language "substantially free of cellular material" includes preparations of a biomarker protein or fragment thereof, having less than about 30% (by dry weight) of non-biomarker protein (also referred to herein as a "contaminating protein"), more preferably less than about 20% of non-biomarker protein, still more preferably less than about 10% of non-biomarker protein, and most preferably less than about 5% non-biomarker protein. When antibody, polypeptide, peptide or fusion protein or fragment thereof, e.g., a biologically active fragment thereof, is recombinantly produced, it is also preferably substantially free of culture medium, i.e., culture medium represents less than about 20%, more preferably less than about 10%, and most preferably less than about 5% of the volume of the protein preparation.

As used herein, the term "isotype" refers to the antibody class (e.g., IgM, IgG1, IgG2C, and the like) that is encoded by heavy chain constant region genes.

The "normal" level of expression of a biomarker is the level of expression of the biomarker in cells of a subject, e.g., a human patient, not afflicted with a cancer. An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

An "over-expression" or "significantly higher level of expression" of a biomarker refers to an expression level in a test sample that is greater than the standard error of the assay employed to assess expression, and is preferably at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more higher than the expression activity or level of the biomarker in a control sample (e.g., sample from a healthy subject not having the biomarker associated disease) and preferably, the average expression level of the biomarker in several control samples. A "significantly lower level of expression" of a biomarker refers to an expression level in a test sample that is at least 10%, and more preferably 1.2, 1.3, 1.4, 1.5, 1.6, 1.7, 1.8, 1.9, 2.0, 2.1, 2.1, 2.2, 2.3, 2.4, 2.5, 2.6, 2.7, 2.8, 2.9, 3, 3.5, 4, 4.5, 5, 5.5, 6, 6.5, 7, 7.5, 8, 8.5, 9, 9.5, 10, 10.5, 11, 12, 13, 14, 15, 16, 17, 18, 19, 20 times or more lower than the expression level of the biomarker in a control sample (e.g., sample from a healthy subject not having the biomarker associated disease) and preferably, the average expression level of the biomarker in several control samples.

The term "predictive" includes the use of a biomarker nucleic acid and/or protein status, e.g., over- or under-activity, emergence, expression, growth, remission, recurrence or resistance of tumors before, during or after therapy, for determining the likelihood of response of a cancer to a cancer vaccine alone or in combination with an immunotherapy and/or cancer therapy. Such predictive use of the biomarker may be confirmed by, e.g., (1) increased or decreased copy number (e.g., by FISH, FISH plus SKY, single-molecule sequencing, e.g., as described in the art at least at J. Biotechnol., 86:289-301, or qPCR), overexpression or underexpression of a biomarker nucleic acid (e.g., by ISH, Northern Blot, or qPCR), increased or decreased biomarker protein (e.g., by IHC), or increased or decreased activity, e.g., in more than about 5%, 6%, 7%, 8%, 9%, 10%, 11%, 12%, 13%, 14%, 15%, 20%, 25%, 30%, 40%, 50%, 60%, 70%, 80%, 90%, 95%, 100%, or more of assayed human cancers types or cancer samples; (2) its absolute or relatively modulated presence or absence in a biological sample, e.g., a sample containing tissue, whole blood, serum, plasma, buccal scrape, saliva, cerebrospinal fluid, urine, stool, or bone marrow, from a subject, e.g. a human, afflicted with cancer; (3) its absolute or relatively modulated presence or absence in clinical subset of patients with cancer (e.g., those responding to the cancer vaccine alone or in combination with an immunotherapy and/or cancer therapy, or those developing resistance thereto).

The terms "prevent," "preventing," "prevention," "prophylactic treatment," and the like refer to reducing the probability of developing a disease, disorder, or condition in a subject, who does not have, but is at risk of or susceptible to developing a disease, disorder, or condition.

The term "cancer response," "response to immunotherapy," or "response to modulators of T-cell mediated cytotoxicity/immunotherapy combination therapy" relates to any response of the hyperproliferative disorder (e.g., cancer) to a cancer agent, such as a modulator of T-cell mediated cytotoxicity, and an immunotherapy, preferably to a change in tumor mass and/or volume after initiation of neoadjuvant or adjuvant therapy. Hyperproliferative disorder response may be assessed, for example for efficacy or in a neoadjuvant or adjuvant situation, where the size of a tumor after systemic intervention can be compared to the initial size and dimensions as measured by CT, PET, mammogram, ultrasound or palpation. Responses may also be assessed by caliper measurement or pathological examination of the tumor after biopsy or surgical resection. Response may be recorded in a quantitative fashion like percentage change in tumor volume or in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of hyperproliferative disorder response may be done early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed. This is typically three months after initiation of neoadjuvant therapy. In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular cancer therapeutic regimen is at least 25%, 30%, 35%, 40%, 45%, 50%, 55%, 60%, 65%, 70%, 75%, 80%, 85%, or more. Additional criteria for evaluating the response to cancer therapies are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence. For example, in order to determine appropriate threshold values, a particular cancer therapeutic regimen can be administered to a population of subjects and the outcome can be correlated to biomarker measurements that were determined prior to administration of any cancer therapy. The outcome measurement may be pathologic response to therapy given in the neoadjuvant setting. Alternatively, outcome measures, such as overall survival and disease-free survival can be monitored over a period of time for subjects following cancer therapy for which biomarker measurement values are known. In certain embodiments, the doses administered are standard doses known in the art for cancer therapeutic agents. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of a cancer therapy can be determined using well-known methods in the art, such as those described in the Examples section.

The term "resistance" refers to an acquired or natural resistance of a cancer sample or a mammal to a cancer therapy (i.e., being nonresponsive to or having reduced or limited response to the therapeutic treatment), such as having a reduced response to a therapeutic treatment by 5%, 10%, 15%, 20%, 25%, 30%, 35%, 40%, 45%, 50%, 55%, 60%, 65%, 70%, 75%, 80%, 85%, 90%, 95%, 100%, or more, such 2-fold, 3-fold, 4-fold, 5-fold, 10-fold, 15-fold, 20-fold or more, or any range in between, inclusive. The reduction in response can be measured by comparing with the same cancer sample or mammal before the resistance is acquired, or by comparing with a different cancer sample or a mammal that is known to have no resistance to the therapeutic treatment. A typical acquired resistance to chemotherapy is called "multidrug resistance." The multidrug resistance can be mediated by P-glycoprotein or can be mediated by other mechanisms, or it can occur when a mammal is infected with a multi-drug-resistant microorganism or a combination of microorganisms. The determination of resistance to a therapeutic treatment is routine in the art and within the skill of an ordinarily skilled clinician, for example, can be measured by cell proliferative assays and cell death assays as described herein as "sensitizing." In some embodiments, the term "reverses resistance" means that the use of a second agent in combination with a primary cancer therapy (e.g., chemotherapeutic or radiation therapy) is able to produce a significant decrease in tumor volume at a level of statistical significance (e.g., $p<0.05$) when compared to tumor volume of untreated tumor in the circumstance where the primary cancer therapy (e.g., chemotherapeutic or radiation therapy) alone is unable to produce a statistically significant decrease in tumor volume compared to tumor volume of untreated tumor. This generally applies to tumor volume measurements made at a time when the untreated tumor is growing log rhythmically.

The terms "response" or "responsiveness" refers to a cancer response, e.g. in the sense of reduction of tumor size or inhibiting tumor growth. The terms can also refer to an improved prognosis, for example, as reflected by an increased time to recurrence, which is the period to first recurrence censoring for second primary cancer as a first event or death without evidence of recurrence, or an increased overall survival, which is the period from treatment to death from any cause. To respond or to have a response means there is a beneficial endpoint attained when exposed to a stimulus. Alternatively, a negative or detrimental symptom is minimized, mitigated or attenuated on exposure to a stimulus. It will be appreciated that evaluating the likelihood that a tumor or subject will exhibit a favorable response is equivalent to evaluating the likelihood that the tumor or subject will not exhibit favorable response (i.e., will exhibit a lack of response or be non-responsive).

An "RNA interfering agent" as used herein, is defined as any agent which interferes with or inhibits expression of a target biomarker gene by RNA interference (RNAi). Such RNA interfering agents include, but are not limited to, nucleic acid molecules including RNA molecules which are homologous to the target biomarker gene of the present invention, or a fragment thereof, short interfering RNA (siRNA), and small molecules which interfere with or inhibit expression of a target biomarker nucleic acid by RNA interference (RNAi).

"RNA interference (RNAi)" is an evolutionally conserved process whereby the expression or introduction of RNA of a sequence that is identical or highly similar to a target biomarker nucleic acid results in the sequence specific degradation or specific post-transcriptional gene silencing (PTGS) of messenger RNA (mRNA) transcribed from that targeted gene (see Coburn and Cullen (2002) *J. Virol.* 76:9225), thereby inhibiting expression of the target biomarker nucleic acid. In one embodiment, the RNA is double stranded RNA (dsRNA). This process has been described in plants, invertebrates, and mammalian cells. In nature, RNAi is initiated by the dsRNA-specific endonuclease Dicer, which promotes processive cleavage of long dsRNA into double-stranded fragments termed siRNAs. siRNAs are incorporated into a protein complex that recognizes and cleaves target mRNAs. RNAi can also be initiated by introducing nucleic acid molecules, e.g., synthetic siRNAs or RNA interfering agents, to inhibit or silence the expression of target biomarker nucleic acids. As used herein, "inhibition of target biomarker nucleic acid expression" or "inhibition of marker gene expression" includes any decrease in expression or protein activity or level of the target biomarker nucleic acid or protein encoded by the target biomarker nucleic acid. The decrease may be of at least 30%, 40%, 50%, 60%, 70%, 80%, 90%, 95% or 99% or more as compared to the expression of a target biomarker nucleic acid or the activity or level of the protein encoded by a target biomarker nucleic acid which has not been targeted by an RNA interfering agent.

In addition to RNAi, genome editing can be used to modulate the copy number or genetic sequence of a biomarker of interest, such as constitutive or induced knockout or mutation of a biomarker of interest. For example, the CRISPR-Cas system can be used for precise editing of genomic nucleic acids (e.g., for creating non-functional or null mutations). In such embodiments, the CRISPR guide RNA and/or the Cas enzyme may be expressed. For example, a vector containing only the guide RNA can be administered to an animal or cells transgenic for the Cas9 enzyme. Similar strategies may be used (e.g., designer zinc finger, transcription activator-like effectors (TALEs) or homing meganucleases). Such systems are well-known in the art (see, for example, U.S. Pat. No. 8,697,359; Sander and Joung (2014) *Nat. Biotech.* 32:347-355; Hale et al. (2009) *Cell* 139:945-956; Karginov and Hannon (2010) *Mol. Cell* 37:7; U.S. Pat. Publ. 2014/0087426 and 2012/0178169; Boch et al. (2011) *Nat. Biotech.* 29:135-136; Boch et al. (2009) *Science* 326:1509-1512; Moscou and Bogdanove (2009) *Science* 326:1501; Weber et al. (2011) *PLoS One* 6:e19722; Li et al. (2011) *Nucl. Acids Res.* 39:6315-6325; Zhang et al. (2011) *Nat. Biotech.* 29:149-153; Miller et al. (2011) *Nat. Biotech.* 29:143-148; Lin et al. (2014) *Nucl. Acids Res.* 42:e47). Such genetic strategies can use constitutive expression systems or inducible expression systems according to well-known methods in the art.

"Piwi-interacting RNA (piRNA)" is the largest class of small non-coding RNA molecules. piRNAs form RNA-protein complexes through interactions with piwi proteins. These piRNA complexes have been linked to both epigenetic and post-transcriptional gene silencing of retrotransposons and other genetic elements in germ line cells, particularly those in spermatogenesis. They are distinct from microRNA (miRNA) in size (26-31 nt rather than 21-24 nt), lack of sequence conservation, and increased complexity. However, like other small RNAs, piRNAs are thought to be involved in gene silencing, specifically the silencing of transposons. The majority of piRNAs are antisense to transposon sequences, suggesting that transposons are the piRNA target. In mammals it appears that the activity of piRNAs in transposon silencing is most important during the development of the embryo, and in both *C. elegans* and humans, piRNAs are necessary for spermatogenesis. piRNA has a role in RNA silencing via the formation of an RNA-induced silencing complex (RISC).

"Aptamers" are oligonucleotide or peptide molecules that bind to a specific target molecule. "Nucleic acid aptamers" are nucleic acid species that have been engineered through repeated rounds of in vitro selection or equivalently, SELEX (systematic evolution of ligands by exponential enrichment) to bind to various molecular targets such as small molecules, proteins, nucleic acids, and even cells, tissues and organisms. "Peptide aptamers" are artificial proteins selected or engineered to bind specific target molecules. These proteins consist of one or more peptide loops of variable sequence displayed by a protein scaffold. They are typically isolated from combinatorial libraries and often subsequently improved by directed mutation or rounds of variable region mutagenesis and selection. The "Affimer protein", an evolution of peptide aptamers, is a small, highly stable protein engineered to display peptide loops which provides a high affinity binding surface for a specific target protein. It is a protein of low molecular weight, 12-14 kDa, derived from the cysteine protease inhibitor family of cystatins. Aptamers are useful in biotechnological and therapeutic applications as they offer molecular recognition properties that rival that of the commonly used biomolecule, antibodies. In addition to their discriminate recognition, aptamers offer advantages over antibodies as they can be engineered completely in a test tube, are readily produced by chemical synthesis, possess desirable storage properties, and elicit little or no immunogenicity in therapeutic applications.

As used herein, the term "intracellular immunoglobulin molecule" is a complete immunoglobulin which is the same as a naturally-occurring secreted immunoglobulin, but which remains inside of the cell following synthesis. An "intracellular immunoglobulin fragment" refers to any fragment, including single-chain fragments of an intracellular immunoglobulin molecule. Thus, an intracellular immunoglobulin molecule or fragment thereof is not secreted or expressed on the outer surface of the cell. Single-chain intracellular immunoglobulin fragments are referred to herein as "single-chain immunoglobulins." As used herein, the term "intracellular immunoglobulin molecule or fragment thereof" is understood to encompass an "intracellular immunoglobulin," a "single-chain intracellular immunoglobulin" (or fragment thereof), an "intracellular immunoglobulin fragment," an "intracellular antibody" (or fragment thereof), and an "intrabody" (or fragment thereof). As such, the terms "intracellular immunoglobulin," "intracellular Ig," "intracellular antibody," and "intrabody" may be used interchangeably herein, and are all encompassed by the generic definition of an "intracellular immunoglobulin molecule, or fragment thereof." An intracellular immunoglobulin molecule, or fragment thereof of the present invention may, in some embodiments, comprise two or more subunit polypeptides, e.g., a "first intracellular immunoglobulin subunit polypeptide" and a "second intracellular immunoglobulin subunit polypeptide." However, in other embodiments, an intracellular immunoglobulin may be a "single-chain intracellular immunoglobulin" including only a single polypeptide. As used herein, a "single-chain intracellular immunoglobulin" is defined as any unitary fragment that has a desired activity, for example, intracellular binding to an antigen. Thus, single-chain intracellular immunoglobulins encompass those which comprise both heavy and light chain variable regions which act together to bind antigen, as well as single-chain intracellular immunoglobulins which only have a single variable region which binds antigen, for example, a "camelized" heavy chain variable region as described herein. An intracellular immunoglobulin or Ig fragment may be expressed anywhere substantially within the cell, such as in the cytoplasm, on the inner surface of the cell membrane, or in a subcellular compartment (also referred to as cell subcompartment or cell compartment) such as the nucleus, Golgi, endoplasmic reticulum, endosome, mitochondria, etc. Additional cell subcompartments include those that are described herein and well known in the art.

The term "sample" used for detecting or determining the presence or level of at least one biomarker is typically whole blood, plasma, serum, saliva, urine, stool (e.g., feces), tears, and any other bodily fluid (e.g., as described above under the definition of "body fluids"), or a tissue sample (e.g., biopsy) such as bone marrow and bone sample, or surgical resection tissue. In certain instances, the method of the present invention further comprises obtaining the sample from the individual prior to detecting or determining the presence or level of at least one marker in the sample.

The term "sensitize" means to alter cancer cells or tumor cells in a way that allows for more effective treatment of the associated cancer with a cancer therapy (e.g., anti-immune checkpoint, chemotherapeutic, and/or radiation therapy). In some embodiments, normal cells are not affected to an extent that causes the normal cells to be unduly injured by the therapies. An increased sensitivity or a reduced sensitivity to a therapeutic treatment is measured according to a known method in the art for the particular treatment and methods described herein below, including, but not limited to, cell proliferative assays (Tanigawa N, Kern D H, Kikasa Y, Morton D L, Cancer Res 1982; 42: 2159-2164), cell death assays (Weisenthal L M, Shoemaker R H, Marsden J A, Dill P L, Baker J A, Moran E M, Cancer Res 1984; 94: 161-173; Weisenthal L M, Lippman M E, Cancer Treat Rep 1985; 69: 615-632; Weisenthal L M, In: Kaspers G J L, Pieters R, Twentyman P R, Weisenthal L M, Veerman A J P, eds. Drug Resistance in Leukemia and Lymphoma. Langhorne, P A: Harwood Academic Publishers, 1993: 415-432; Weisenthal L M, Contrib Gynecol Obstet 1994; 19: 82-90). The sensitivity or resistance may also be measured in animal by measuring the tumor size reduction over a period of time, for example, 6 month for human. A composition or a method sensitizes response to a therapeutic treatment if the increase in treatment sensitivity or the reduction in resistance is 5%, 10%, 15%, 20%, 25%, 30%, 35%, 40%, 45%, 50%, 55%, 60%, 65%, 70%, 75%, 80%, 85%, 90%, 95%, 100%, or more, such 2-fold, 3-fold, 4-fold, 5-fold, 10-fold, 15-fold, 20-fold or more, or any range in between, inclusive, compared to treatment sensitivity or resistance in the absence of such composition or method. The determination of sensitivity or resistance to a therapeutic treatment is routine in the art and within the skill of an ordinarily skilled clinician. It is to be understood that any method described herein for enhancing the efficacy of a cancer therapy can be equally applied to methods for sensitizing hyperproliferative or otherwise cancerous cells (e.g., resistant cells) to the cancer therapy.

"Short interfering RNA" (siRNA), also referred to herein as "small interfering RNA" is defined as an agent which functions to inhibit expression of a target biomarker nucleic acid, e.g., by RNAi. An siRNA may be chemically synthesized, may be produced by in vitro transcription, or may be produced within a host cell. In one embodiment, siRNA is a double stranded RNA (dsRNA) molecule of about 15 to about 40 nucleotides in length, preferably about 15 to about 28 nucleotides, more preferably about 19 to about 25 nucleotides in length, and more preferably about 19, 20, 21, or 22 nucleotides in length, and may contain a 3' and/or 5' overhang on each strand having a length of about 0, 1, 2, 3, 4, or 5 nucleotides. The length of the overhang is independent between the two strands, i.e., the length of the overhang on one strand is not dependent on the length of the overhang on the second strand. Preferably the siRNA is capable of promoting RNA interference through degradation or specific post-transcriptional gene silencing (PTGS) of the target messenger RNA (mRNA).

In another embodiment, an siRNA is a small hairpin (also called stem loop) RNA (shRNA). In one embodiment, these shRNAs are composed of a short (e.g., 19-25 nucleotide) antisense strand, followed by a 5-9 nucleotide loop, and the analogous sense strand. Alternatively, the sense strand may precede the nucleotide loop structure and the antisense strand may follow. These shRNAs may be contained in plasmids, retroviruses, and lentiviruses and expressed from, for example, the pol III U6 promoter, or another promoter (see, e.g., Stewart, et al. (2003) RNA April; 9(4):493-501 incorporated by reference herein).

RNA interfering agents, e.g., siRNA molecules, may be administered to a patient having or at risk for having cancer, to inhibit expression of a biomarker gene which is overexpressed in cancer and thereby treat, prevent, or inhibit cancer in the subject.

The term "small molecule" is a term of the art and includes molecules that are less than about 1000 molecular weight or less than about 500 molecular weight. In one embodiment, small molecules do not exclusively comprise peptide bonds. In another embodiment, small molecules are not oligomeric. Exemplary small molecule compounds which can be screened for activity include, but are not limited to, peptides, peptidomimetics, nucleic acids, carbohydrates, small organic molecules (e.g., polyketides) (Cane et al. (1998) *Science* 282:63), and natural product extract libraries. In another embodiment, the compounds are small, organic non-peptidic compounds. In a further embodiment, a small molecule is not biosynthetic.

The term "specific binding" refers to antibody binding to a predetermined antigen. Typically, the antibody binds with an affinity ($K_D$) of approximately less than $10^{-7}$M, such as approximately less than $10^{-8}$ M, $10^{-9}$M or $10^{-10}$ M or even lower when determined by surface plasmon resonance (SPR) technology in a BIACORE® assay instrument using an antigen of interest as the analyte and the antibody as the ligand, and binds to the predetermined antigen with an affinity that is at least 1.1-, 1.2-, 1.3-, 1.4-, 1.5-, 1.6-, 1.7-, 1.8-, 1.9-, 2.0-, 2.5-, 3.0-, 3.5-, 4.0-, 4.5-, 5.0-, 6.0-, 7.0-, 8.0-, 9.0-, or 10.0-fold or greater than its affinity for binding to a non-specific antigen (e.g., BSA, casein) other than the predetermined antigen or a closely-related antigen. The phrases "an antibody recognizing an antigen" and "an antibody specific for an antigen" are used interchangeably herein with the term "an antibody which binds specifically to an antigen." Selective binding is a relative term referring to the ability of an antibody to discriminate the binding of one antigen over another.

The term "subject" refers to any healthy animal, mammal or human, or any animal, mammal or human afflicted with a cancer, e.g., brain, lung, ovarian, pancreatic, liver, breast, prostate, and/or colorectal cancers, melanoma, multiple myeloma, and the like. The term "subject" is interchangeable with "patient."

The term "survival" includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g. time of diagnosis or start of treatment) and end point (e.g. death, recurrence or metastasis). In addition, criteria for efficacy of treatment can be expanded to include response to chemotherapy, probability of survival, probability of metastasis within a given time period, and probability of tumor recurrence.

The term "synergistic effect" refers to the combined effect of two or more cancer agents (e.g., a cancer vaccine in combination with immunotherapy) can be greater than the sum of the separate effects of the cancer agents/therapies alone.

The term "T cell" includes $CD4^+$ T cells and $CD8^+$ T cells. The term T cell also includes both T helper 1 type T cells and T helper 2 type T cells. The term "antigen presenting cell" includes professional antigen presenting cells (e.g., B lymphocytes, monocytes, dendritic cells, Langerhans cells), as well as other antigen presenting cells (e.g., keratinocytes, endothelial cells, astrocytes, fibroblasts, and oligodendrocytes).

The term "therapeutic effect" refers to a local or systemic effect in animals, particularly mammals, and more particularly humans, caused by a pharmacologically active substance. The term thus means any substance intended for use in the diagnosis, cure, mitigation, treatment or prevention of disease or in the enhancement of desirable physical or mental development and conditions in an animal or human. The phrase "therapeutically-effective amount" means that amount of such a substance that produces some desired local or systemic effect at a reasonable benefit/risk ratio applicable to any treatment. In certain embodiments, a therapeutically effective amount of a compound will depend on its therapeutic index, solubility, and the like. For example, certain compounds discovered by the methods of the present invention may be administered in a sufficient amount to produce a reasonable benefit/risk ratio applicable to such treatment.

The terms "therapeutically-effective amount" and "effective amount" as used herein means that amount of a compound, material, or composition comprising a compound of the present invention which is effective for producing some desired therapeutic effect in at least a sub-population of cells in an animal at a reasonable benefit/risk ratio applicable to any medical treatment. Toxicity and therapeutic efficacy of subject compounds may be determined by standard pharmaceutical procedures in cell cultures or experimental animals, e.g., for determining the $LD_{50}$ and the $ED_{50}$. Compositions that exhibit large therapeutic indices are preferred. In some embodiments, the $LD_{50}$ (lethal dosage) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more reduced for the agent relative to no administration of the agent. Similarly, the $ED_{50}$ (i.e., the concentration which achieves a half-maximal inhibition of symptoms) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. Also, Similarly, the $IC_{50}$ (i.e., the concentration which achieves half-maximal cytotoxic or cytostatic effect on cancer cells) can be measured and can be, for example, at least 10%, 20%, 30%, 40%, 50%, 60%, 70%, 80%, 90%, 100%, 200%, 300%, 400%, 500%, 600%, 700%, 800%, 900%, 1000% or more increased for the agent relative to no administration of the agent. In some embodiments, cancer cell growth in an assay can be inhibited by at least about 10%, 15%, 20%, 25%, 30%, 35%, 40%, 45%, 50%, 55%, 60%, 65%, 70%, 75%, 80%, 85%, 90%, 95%, or even 100%. In another embodiment, at least about a 10%, 15%, 20%, 25%, 30%, 35%, 40%, 45%, 50%, 55%, 60%, 65%, 70%, 75%, 80%, 85%, 90%, 95%, or even 100% decrease in a solid malignancy can be achieved.

The term "substantially free of chemical precursors or other chemicals" includes preparations of antibody, polypeptide, peptide or fusion protein in which the protein is separated from chemical precursors or other chemicals which are involved in the synthesis of the protein. In one embodiment, the language "substantially free of chemical precursors or other chemicals" includes preparations of antibody, polypeptide, peptide or fusion protein having less than about 30% (by dry weight) of chemical precursors or non-antibody, polypeptide, peptide or fusion protein chemicals, more preferably less than about 20% chemical precursors or non-antibody, polypeptide, peptide or fusion protein chemicals, still more preferably less than about 10% chemical precursors or non-antibody, polypeptide, peptide or fusion protein chemicals, and most preferably less than about 5% chemical precursors or non-antibody, polypeptide, peptide or fusion protein chemicals.

A "transcribed polynucleotide" or "nucleotide transcript" is a polynucleotide (e.g. an mRNA, hnRNA, a cDNA, or an analog of such RNA or cDNA) which is complementary to or homologous with all or a portion of a mature mRNA made by transcription of a biomarker nucleic acid and normal post-transcriptional processing (e.g. splicing), if any, of the RNA transcript, and reverse transcription of the RNA transcript.

The term "host cell" is intended to refer to a cell into which a nucleic acid encompassed by the present invention, such as a recombinant expression vector encompassed by the present invention, has been introduced. The terms "host cell" and "recombinant host cell" are used interchangeably herein. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

The term "vector" refers to a nucleic acid capable of transporting another nucleic acid to which it has been linked. One type of vector is a "plasmid", which refers to a circular double stranded DNA loop into which additional DNA segments may be ligated. Another type of vector is a viral vector, wherein additional DNA segments may be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" or simply "expression vectors". In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

As used herein, the term "unresponsiveness" includes refractivity of cancer cells to therapy or refractivity of therapeutic cells, such as immune cells, to stimulation, e.g., stimulation via an activating receptor or a cytokine. Unresponsiveness can occur, e.g., because of exposure to immunosuppressants or exposure to high doses of antigen. As used herein, the term "allergy" or "tolerance" includes refractivity to activating receptor-mediated stimulation. Such refractivity is generally antigen-specific and persists after exposure to the tolerizing antigen has ceased. For example, anergy in T cells (as opposed to unresponsiveness) is characterized by lack of cytokine production, e.g., IL-2. T cell anergy occurs when T cells are exposed to antigen and receive a first signal (a T cell receptor or CD-3 mediated signal) in the absence of a second signal (a costimulatory signal). Under these conditions, reexposure of the cells to the same antigen (even if reexposure occurs in the presence of a costimulatory polypeptide) results in failure to produce cytokines and, thus, failure to proliferate. Anergic T cells can, however, proliferate if cultured with cytokines (e.g., IL-2). For example, T cell anergy can also be observed by the lack of IL-2 production by T lymphocytes as measured by ELISA or by a proliferation assay using an indicator cell line. Alternatively, a reporter gene construct can be used. For example, anergic T cells fail to initiate IL-2 gene transcription induced by a heterologous promoter under the control of the 5' IL-2 gene enhancer or by a multimer of the AP1 sequence that can be found within the enhancer (Kang et al. (1992) *Science* 257:1134).

The term "TGFβ-Smad/p63 signaling pathway" refers to one branch of the TGFβ signaling pathway. The TGFβ signaling pathway is involved in many cellular processes in both the adult organism and the developing embryo including but are not limited to cell growth, cell differentiation, apoptosis, cellular homeostasis and other cellular functions. In some embodiments, TGFβ superfamily ligands (e.g., TGFβ1, TGFβ2, and/or TGFβ3) bind to a type II receptor, which recruits and phosphorylates a type I receptor. The type I receptor then phosphorylates receptor-regulated SMADs (R-SMADs; e.g., SMAD1, SMAD2, SMAD3, SMAD5, or SMAD9) which can now bind the coSMAD (e.g., SMAD4). R-SMAD/coSMAD complexes accumulate in the nucleus where they act as transcription factors and participate in the regulation of target gene expression. In the branch of the "TGFβ-Smad/p63 signaling pathway", R-SMAD/coSMAD complexes further associate with p63 in the nucleus to regulate target gene expression. In one embodiment, R-SMAD is Smad2. TGFβ-Smad/p63 signaling pathway activation can be assessed by analyzing, for example, Smad2 phosphorylation, Smad2 nuclear translocation, association of Smad2 with p63, and/or the activation of the TGFβ-Smad/p63 signature genes. The TGFβ-Smad/p63 signatures may include, but are not limited to, upregulation of ICOSL, PYCARD, SFN, PERP, RIPK3, and/or SESN1, and/or downregulation of KSR1, EIF4EBP1, ITGA5, EMILIN1, CD200, and/or CSF1.

In some embodiments, upon binding to its receptors, TGFβ promotes the formation of TGFBRII and TGFBR1 heterodimers on cell plasma membrane. The cytoplasmic signaling molecules R-Smads (such as Smad2 and Smad3) are then phosphorylated by the activated TGFBRI. The activated R-Smads form a complex with Co-Smad (such as Smad4) and translocate into the cell nucleus. As demonstrated herein, by partnering with p63 (or other p53 family members such as p53 or p73), the Smads/p63 trancriptional complex upregulates proinflammatory genes (such as Icosl, Nfkbib, Tnfaip3, Pik3r1, and Perp) and dowregulates oncogenic genes (such as Cd200, Cxcl5, Csf1, Pdgfrb, Fgfr1, Vegfa). Therefore tumor cells with activated TGFβ-Smads/p63 signatures display strong "eat me" signals to the immune system and trigger antitumor immune responses by recruiting antigen presenting cells (such dendritic cell). The dendritic cells (DCs) take up tumor specific antigens and promote tumor specific effector and memory T cell responses to provide the host with full protection against tumors. The TGFβ-Smad/p63 signaling pathway can be activated by modulating signaling molecules involved in this pathway. In specific embodiments, Smad superfamilies (including Smad1, Smad2, Smad3, Smad4, Smad5, Smad6, Smad7, and Smad9) and p53 superfamilies (including p53, p63, and p73) are modulated to activate the TGFβ-Smad/p63 signaling pathway in the compositions and methods encompassed by the present invention.

The TGFβ-Smad/p63 signaling pathway can be by activated by providing a TGFβ superfamily ligand or an agonist of the TGFβ signaling pathway. It can also be regulated and/or at the level of Smad and p63. Exemplary agents useful for activating TGFβ-Smad/p63 signaling pathway, or other biomarkers described herein, include small molecules, peptides, and nucleic acids, etc. that can upregulate the expression and/or activity of one or more biomarkers listed in Table 1, or fragments thereof; and/or decrease the copy number, amount, and/or activity of one or more biomarkers listed in Table 2, or fragments thereof. Exemplary agents useful for activating TGFβ-Smad/p63 signaling pathway, or other biomarkers described herein, also include TGFβ superfamily ligands.

In one embodiment, suitable agonists include naturally-occurring agonists of the TGFβ superfamily member, or fragments and variants thereof. For example, agonists of TGFβ signaling may include a soluble form of endoglin, see, for example, U.S. Pat. Nos. 5,719,120, 5,830,847, and 6,015,693, each of which is incorporated herein by reference in its entirety. In another embodiment, suitable agonists may include inhibitors of naturally-occurring TGFβ antagonists. Multiple naturally-occurring modulators have been identified that regulate TGFβ signaling. For example, access of TGFβ ligands to receptors is inhibited by the soluble proteins LAP, decorin and α2-macroglobulin that bind and sequester the ligands (Balemans and Van Hul (2002) *Dev. Biol.* 250:231-250). TGFβ ligand access to receptors is also controlled by membrane-bound receptors. BAMBI acts as a decoy receptor, competing with the type I receptor (Onichtchouk et al. (1999) *Nature* 401:480-485); betaglycan (TGFβ type II receptor) enhances TGFβ binding to the type II receptor (Brown et al. (1999) *Science* 283:2080-2082, *Massagué* (1998) *Annu. Rev. Biochem.* 67:753-791, del Re et al. (2004) *J. Biol. Chem.* 279:22765-22772); and endoglin enhances TGFβ binding to ALK1 in endothelial cells (Marchuk (1998) *Curr. Opin. Hematol.* 5:332-338; Massagué (2000) *Nat. Rev. Mol. Cell. Biol.* 1: 169-178; Shi and Massagué (2003) *Cell* 113:685-700). Cripto, an EGF-CFC GPI-anchored membrane protein, acts as a co-receptor, increasing the binding of the TGFβ ligands, nodal, Vg1, and GDF1 to activin receptors (Cheng et al. (2003) *Genes Dev.* 17:31-36, Shen and Schier (2000) *Trends Genet.* 16:303-309) while blocking activin signaling. Suitable agonists also include synthetic or human recombinant compounds. Classes of molecules that can function as agonists include, but are not limited to, small molecules, antibodies (including fragments or variants thereof, such as Fab fragments, Fab'2 fragments and scFvs), and peptidomimetics.

As used herein, the term "TGFβ superfamily" refers to a large family of multifunctional proteins that regulate a variety of cellular functions including cellular proliferation, migration, differentiation and apoptosis. The TGFβ superfamily presently comprises more than 30 members, including, among others, activins, inhibins, Transforming Growth Factors-beta (TGFβs), Growth and Differentiation Factors (GDFs), Bone Morphogenetic Proteins (BMPs), and Müllerian inhibiting Substance (MIS). All of these molecules are peptide growth factors that are structurally related to TGFβ. They all share a common motif called a cysteine knot, which is constituted by seven especially conservative cysteine residues organized in a rigid structure (Massagué (1998) *Annu. Rev. Biochem.* 67:753-791). Unlike classical hormones, members of the TGFβ superfamily are multifunctional proteins whose effects depend on the type and stage of the target cells as much as the growth factors themselves.

TGFβ superfamily members suitable for use in the practice of the present invention include any member of the TGFβ superfamily that can activate the TGFβ-Smad/p63 signaling pathway. In one embodiment, TGFβ superfamily members are from the TGFβ family, which include but are not limited to, LAP, TGFβ1, TGFβ2, TGFβ3, and TGFβ5. In another embodiment, TGFβ superfamily members are from the Activin family, which include but are not limited to, Activin A, Activin AB, Activin AC, Activin B, Activin C, C17ORF99, INHBA, INHBB, Inhibin, Inhibin A, and Inhibin B. In still another embodiment, TGFβ superfamily members are from the BMP (Bone Morphogenetic Protein) family, which include but are not limited to, BMP-1/PCP, BMP-2, BMP-2/BMP-6 Heterodimer, BMP-2/BMP-7 Heterodimer, BMP-2a, BMP-3, BMP-3b/GDF-10, BMP-4, BMP-4/BMP-7 Heterodimer, BMP-5, BMP-6, BMP-7, BMP-8, BMP-8a, BMP-8b, BMP-9, BMP-10, BMP-15/GDF-9B, and Decapentaplegic/DPP. In yet another embodiment, TGFβ superfamily members are from the GDNF family, which include but are not limited to, Artemin, GDNF, Neurturin, and Persephin. Additional TGFβ superfamily members include Lefty A, Lefty B, MIS/AMH, Nodal, and SCUBE3.

In certain embodiments, TGFβ superfamily members are from the TGFβ family. TGFβ, the founding member of TGFβ family, has been shown to play a variety of roles ranging from embryonic pattern formation to cell growth regulation in adult tissues. Mammalian cells can produce three different isoforms of TGFβ: TGFβ1, TGFβ2, and TGFβ3. These isoforms exhibit the same basic structure (they are homodimers of 112 amino acids that are stabilized by intra- and inter-chain disulfide bonds) and their amino acid sequences present a high degree of homology (>70%). However, each isoform is encoded by a distinct gene, and each is expressed in both a tissue-specific and developmentally regulated fashion (Massagué (1998) *Annu. Rev. Biochem.* 67:753-791). TGFβ exerts its biological functions by signal transduction cascades that ultimately activate and/or suppress expression of a set of specific genes. Cross-linking studies have shown that TGFβ mainly binds to three high-affinity cell-surface proteins, called TGFβ receptors of type I, type II, and type III (Massagué and Like (1985) *J. Biol. Chem.* 260:2636-2645, Cheifetz et al. (1986) *J. Biol. Chem.* 261:9972-9978). In some embodiments, TGFβ triggers its signal by first binding to its type II receptor, then recruiting and activating its type I receptors. The activated type I receptors then phosphorylate its intracellular signal transducer molecules, the Smad proteins (Heldin et al. (1997) *Nature* 390:465-471; Derynck et al. (1998) *Cell* 95:737-740).

The term "TGFβ1" or "Transforming Growth Factor Beta 1" refers to a secreted ligand of the TGFβ superfamily of proteins. Ligands of this family bind various TGFβ receptors leading to recruitment and activation of SMAD family transcription factors that regulate gene expression. The encoded preproprotein is proteolytically processed to generate a latency-associated peptide (LAP) and a mature peptide, and is found in either a latent form composed of a mature peptide homodimer, a LAP homodimer, and a latent TGFβ binding protein, or in an active form consisting solely of the mature peptide homodimer. The mature peptide can also form heterodimers with other TGFβ family members. Activation into mature form follows different steps: following cleavage of the proprotein in the Golgi apparatus, LAP and TGFβ1 chains remain non-covalently linked rendering TGFβ1 inactive during storage in extracellular matrix. At the same time, LAP chain interacts with "milieu molecules", LTBP1, LRRC32/GARP and LRRC33/NRROS, that control activation of TGFβ1 and maintain it in a latent state during storage in extracellular milieus. TGF-beta-1 is released from LAP by integrins. Integrin-binding to LAP stabilizes an alternative conformation of the LAP bowtie tail and results in distortion of the LAP chain and subsequent release of the active TGFβ1. Once activated following release of LAP, TGFβ1 acts by binding to TGFβ receptors, which transduce signal. In preferred embodiment, the term "TGFβ1" refers to the activated TGFβ1.

TGFβ1 regulates cell proliferation, differentiation and growth, and can modulate expression and activation of other growth factors including interferon gamma and tumor necrosis factor alpha. TGFβ1 plays an important role in bone remodeling. It acts as a potent stimulator of osteoblastic bone formation, causing chemotaxis, proliferation and differentiation in committed osteoblasts. It can promote either T-helper 17 cells (Th17) or regulatory T-cells (Treg) lineage differentiation in a concentration-dependent manner. At high concentrations, TGFβ1 leads to FOXP3-mediated suppression of RORC and down-regulation of IL-17 expression, favoring Treg cell development. At low concentrations in concert with IL-6 and IL-21, TGFβ1 leads to expression of the IL-17 and IL-23 receptors, favoring differentiation to Th17 cells. TGFβ1 stimulates sustained production of collagen through the activation of CREB3L1 by regulated intramembrane proteolysis (RIP). TGFβ1 mediates SMAD2/3 activation by inducing its phosphorylation and subsequent translocation to the nucleus (Hwangbo et al. (2016) *Oncogene* 35:389-401). It can also induce epithelial-to-mesenchymal transition (EMT) and cell migration in various cell types (Hwangbo et al. (2016) *Oncogene* 35:389-401). TGFβ1 is frequently upregulated in tumor cells, and mutations in this gene result in Camurati-Engelmann disease.

The term "TGFβ1" is intended to include fragments, variants (e.g., allelic variants), and derivatives thereof. Representative human TGFβ1 cDNA and human TGFβ1 protein sequences are well-known in the art and are publicly available from the National Center for Biotechnology Information (NCBI). For example, one human TGFβ1 isoform is known. The human TGFβ1 transcript (NM 000660.7) encodes TGFβ1 proprotein preproprotein (NP_000651.3). Nucleic acid and polypeptide sequences of TGFβ1 orthologs in organisms other than humans are well known and include, for example, chimpanzee TGFβ1 (XM_016936045.2 and XP 016791534.1; XM_512687.6 and XP_512687.2; and XM_009435655.3 and XP_009433930.1); dog TGFβ1 (NM_001003309.1 and NP_001003309.1), cattle TGFβ1 (NM_001166068.1 and NP_001159540.1), mouse TGFβ1 (NM_011577.2 and NP_035707.1), and rat TGFβ1 (NM_021578.2 and NP_067589.1).

The term "TGFβ2" or "transforming growth factor-beta 2" refers to a secreted ligand of the TGFβ superfamily of proteins. As described herein, ligands of this family bind various TGFβ receptors leading to recruitment and activation of SMAD family transcription factors that regulate gene expression. The encoded preproprotein is proteolytically processed to generate a latency-associated peptide (LAP) and a mature peptide, and is found in either a latent form composed of a mature peptide homodimer, a LAP homodimer, and a latent TGFβ binding protein, or in an active form consisting solely of the mature peptide homodimer. The mature peptide may also form heterodimers with other TGFβ family members. Activation into mature form follows different steps: following cleavage of the proprotein in the Golgi apparatus, LAP and TGFβ2 chains remain non-covalently linked rendering TGFβ2 inactive during storage in extracellular matrix. At the same time, LAP chain interacts with "milieu molecules", such as LTBP1 and LRRC32/GARP, that control activation of TGFβ2 and maintain it in a latent state during storage in extracellular milieus. Once activated following release of LAP, TGFβ2 acts by binding to TGFβ receptors, which transduce signal. In preferred embodiment, the term "TGFβ2" refers to the activated TGFβ2. Disruption of the TGFβ/SMAD pathway has been implicated in a variety of human cancers. TGFβ2 regulates various processes such as angiogenesis and heart development (Boileau et al. (2012) *Nat. Genet.* 44:916-921, Lindsay et al. (2012) *Nat. Genet.* 44:922-927). A chromosomal translocation that includes TGFβ2 gene is associated with Peters' anomaly, a congenital defect of the anterior chamber of the eye. Mutations in TGFβ2 gene can be associated with Loeys-Dietz syndrome.

The term "TGFβ2" is intended to include fragments, variants (e.g., allelic variants), and derivatives thereof. Representative human TGFβ2 cDNA and human TGFβ2 protein sequences are well-known in the art and are publicly available from the National Center for Biotechnology Information (NCBI). For example, two human TGFβ2 isoforms are known. The TGFβ2 transcript variant 1 (NM_001135599.3) represents the longest transcript and encodes the longer isoform 1 (NP_001129071.1). The TGFβ2 transcript variant 2 (NM_003238.5) lacks an in-frame exon in the 5' coding region compared to variant 1. The resulting isoform 2 (NM_003238.5) is shorter than isoform 1. Both isoforms may undergo similar proteolytic processing. Nucleic acid and polypeptide sequences of TGFβ2 orthologs in organisms other than humans are well known and include, for example, chimpanzee TGFβ2 (XM_001172158.6 and XP_001172158.1, and XM_514203.7 and XP_514203.2); monkey TGFβ2 (NM_001266518.1 and NP_001253447.1); dog TGFβ2 (XM_005640824.2 and XP_005640881.1, XM_545713.6 and XP_545713.2; and XM_853584.5 and XP_858677.1), cattle TGFβ2 (NM_001113252.1 and NP_001106723.1), mouse TGFβ2 (NM_001329107.1 and NP_001316036.1; and NM_009367.4 and NP_033393.2), rat TGFβ2 (NM_031131.1 and NP_112393.1), and chicken TGFβ2 (NM_001031045.3 and NP_001026216.2).

The term "TGFβ3" or "transforming growth factor-beta 3" refers to a secreted ligand of the TGFβ superfamily of proteins. As described herein, ligands of this family bind various TGFβ receptors leading to recruitment and activation of SMAD family transcription factors that regulate gene expression. The encoded preproprotein is proteolytically processed to generate a latency-associated peptide (LAP) and a mature peptide, and is found in either a latent form composed of a mature peptide homodimer, a LAP homodimer, and a latent TGFβ binding protein, or in an active form consisting solely of the mature peptide homodimer. The mature peptide may also form heterodimers with other TGFβ family members. Activation of TGFβ3 into mature form follows different steps. Following cleavage of the proprotein in the Golgi apparatus, LAP and TGFβ3 chains remain non-covalently linked rendering TGFβ3 inactive during storage in extracellular matrix. At the same time, LAP chain interacts with "milieu molecules", such as LTBP1 and LRRC32/GARP that control activation of TGFβ3 and maintain it in a latent state during storage in extracellular milieus. TGFβ3 is released from LAP by integrins. Integrin-binding results in distortion of the LAP chain and subsequent release of the active TGFβ-3. Once activated following release of LAP, TGFβ-3 acts by binding to TGFβ receptors, which transduce signal. In preferred embodiment, the term "TGFβ3" refers to the activated TGFβ3.

TGFβ3 is involved in embryogenesis and cell differentiation, and can play a role in wound healing. TGFβ3 is required in various processes such as secondary palate development. Mutations in TGFβ3 gene are a cause of aortic aneurysms and dissections, as well as familial arrhythmogenic right ventricular dysplasia 1.

The term "TGFβ3" is intended to include fragments, variants (e.g., allelic variants), and derivatives thereof. Representative human TGFβ3 cDNA and human TGFβ3 protein sequences are well-known in the art and are publicly available from the National Center for Biotechnology Information (NCBI). For example, three human TGFβ3 isoforms are known. The TGFβ3 transcript variant 1 (NM_003239.4) represents the longest transcript and encodes the longer isoform 1 (NP_003230.1). The TGFβ3 transcript variant 2 (NM_001329939.1) differs in the 5' UTR compared to variant 1, and encodes the same isoform (NP_001316868.1) as that of variant 1. The TGFβ3 transcript variant 3 (NM_001329938.2) lacks several exons and its 3' terminal exon extends past a splice site that is used in variant 1. This results in an early stop codon and a novel 3' UTR compared to variant 1. The encoded isoform 2 (NP_001316867.1) has a shorter C-terminus than isoform 1. Nucleic acid and polypeptide sequences of TGFβ3 orthologs in organisms other than humans are well known and include, for example, chimpanzee TGFβ3 (XM_016926465.2 and XP_016781954.1, XM_016926464.2 and XP_016781953.1, XM_001161669.5 and XP_001161669.1, and XM_009428178.2 and XP_009426453.1); monkey TGFβ3 (NM_001257475.1 and NP_001244404.1); dog TGFβ3 (XM_849026.5 and XP_854119.2), cattle TGFβ3 (NM_001101183.1 and NP_001094653.1), mouse TGFβ3 (NM_009368.3 and NP_033394.2), rat TGFβ3 (NM_013174.2 and NP_037306.1), and chicken TGFβ3 (NM_205454.1 and NP_990785.1).

The term "Smad" refers to a family of receptor-activated, signal transducing transcription factors that transmit signals from TGFβ family receptors. Members of the Smad family of proteins have been identified based on homology to the *Drosophila* gene Mothers against dpp (mad), which encodes an essential element in the *Drosophila* dpp signal transduction pathway (Sekelsky et al. (1995) *Genetics* 139:1347-1358, Newfeld et al. (1996) *Development* 122:2099-2108). Smad proteins are generally characterized by highly conserved amino- and carboxy-terminal domains separated by a proline-rich linker. The amino terminal domain (the MH1 domain) mediates DNA binding, and the carboxy terminal domain (the MH2 domain) associates with the receptor.

At least eight Smad proteins have been identified and shown to participate in signal responses induced by TGFβ family members (Kretzschmar and Massagué (1998) *Current Opinion in Genetics and Development* 8:103-111). These Smads can be divided into three subgroups. One group (Smads1, 2, 3, 5 and 9) includes Smads that are direct substrates of a TGFβ family receptor kinase. Another group (Smad 4) includes Smads that are not direct receptor substrates, but participate in signaling by associating with receptor-activated Smads. The third group of Smads (Smad6 and Smad7) consists of proteins that inhibit activation of Smads in the first two groups.

Smads have specific roles in pathways of different TGFβ family members. Among Smad proteins identified for TGFβ family members, Smad2 and Smad3 are specific for TGFβ signaling (Heldin et al. (1997) *Nature* 390:465-471). The activated Smad2 and Smad3 interact with common mediator Smad4 and translocate into nuclei, where they activate a set of specific genes (Heldin et al. (1997) *Nature* 390:465-471). The TGFβ pathway uses the signal inhibitory proteins Smad6 and Smad7 to balance the net output of the signaling, as well as direct activation of Smad2 and/or Smad3.

While Smad2 and Smad3 have intrinsic transactivation activity as transcription factors (Zawel et al. (1998) *Mol. Cell.* 1:611-617), studies have demonstrated that they activate specific gene expression largely through specifically interacting with other nuclear factors (Derynck et al. (1998) *Cell* 95:737-740). A specific TGFβ-mediated effect on a given cell type can be achieved by activating a specific Smad protein, resulting in alterations in expression of specific genes. Smad proteins of particular interest include, for example, Smad2 (Nakao et al (1997) *J. Biol. Chem.* 272: 2896-2900).

The term "SMAD2" refers to SMAD family member 2, which belongs to the SMAD, a family of proteins similar to the gene products of the *Drosophila* gene "mothers against decapentaplegic" (Mad) and the *C. elegans* gene Sma. SMAD proteins are signal transducers and transcriptional modulators that mediate multiple signaling pathways. SMAD2 mediates the signal of TGFβ, and thus regulates multiple cellular processes, such as cell proliferation, apoptosis, and differentiation. SMAD2 is recruited to the TGFβ receptors through its interaction with the SMAD anchor for receptor activation (SARA) protein. In response to TGFβ signal, SMAD2 is phosphorylated by the TGFβ receptors. The phosphorylation induces the dissociation of SMAD2 with SARA and the association with the family member SMAD4. The association with SMAD4 is important for the translocation of SMAD2 into the nucleus, where it binds to target promoters and forms a transcription repressor complex with other cofactors (e.g., p63). It binds the TRE element in the promoter region of many genes that are regulated by TGFβ. SMAD2 can also be phosphorylated by activin type 1 receptor kinase, and mediates the signal from the activin. SMAD2 can act as a tumor suppressor in colorectal carcinoma. It positively regulates PDPK1 kinase activity by stimulating its dissociation from the 14-3-3 protein YWHAQ which acts as a negative regulator. In one embodiment, the human SMAD2 protein has 467 amino acids and a molecular mass of 52306 Da.

The term "SMAD2" is intended to include fragments, variants (e.g., allelic variants), and derivatives thereof. Representative human SMAD2 cDNA and human SMAD2 protein sequences are well-known in the art and are publicly available from the National Center for Biotechnology Information (NCBI). For example, three human SMAD2 isoforms are known. The SMAD2 transcript variant 2 (NM_001003652.4) represents the longest transcript and encodes the longer isoform 1 (NP_001003652.1). The SMAD2 transcript variant 1 (NM_005901.6) uses an alternate exon (1b) in the 5' UTR compared to variant 2, but encodes the same isoform 1 (NP_005892.1). The SMAD2 transcript variant 3 (NM_005901.6) lacks an in-frame exon in the 5' coding region, compared to variant 2, resulting in an isoform 2 (NP_001129409.1) that is shorter than isoform 1. Nucleic acid and polypeptide sequences of SMAD2 orthologs in organisms other than humans are well known and include, for example, chimpanzee SMAD2 (XM_512121.7 and XP_512121.1; XM_001149646.5 and XP_001149646.1; XM_009433959.2 and XP_009432234.1; XM_016933662.1 and XP_016789151.1; XM_016933657.1 and XP_016789146.1, XM_016933659.1 and XP_016789148.1, XM_016933658.1 and XP_016789147.1, XM_009433960.3 and XP_009432235.1, and XM_016933663.1 and XP_016789152.1); monkey SMAD2 (NM_001266803.1 and NP_001253732.1); dog SMAD2 (XM_005622832.3 and XP_005622889.1, XM_022421406.1 and XP_022277114.1; XM_847706.5 and XP_852799.1; XM_005622830.3 and XP_005622887.1; XM_005622831.3 and XP_005622888.1; XM_861095.5 and XP_866188.1; and XM_022421405.1 and XP_022277113.1), cattle SMAD2 (NM_001046218.1 and NP_001039683.1), mouse SMAD2 (NM_001252481.1 and NP_001239410.1; NM_001311070.1 and NP_001297999.1; and NM_010754.5 and NP_034884.2), rat SMAD2 (NM_001277450.1 and NP_001264379.1; and NM_019191.2 and NP_062064.1), and chicken SMAD2 (NM_204561.1 and NP_989892.1). Representative sequences of SMAD2 orthologs are presented below in Table 1.

Anti-SMAD2 antibodies suitable for detecting SMAD2 protein are well-known in the art and include, for example, antibodies AM06653SU-N and AM31101PU-N(OriGene Technologies, Rockville, MD), AF3797, NB100-56462, NBP2-67376, and NBP2-44217 (antibodies from Novus Biologicals, Littleton, CO), ab40855, ab63576, and ab202445, (antibodies from AbCam, Cambridge, MA), etc. In addition, reagents are well-known for detecting SMAD2 expression. Moreover, multiple siRNA, shRNA, CRISPR constructs for reducing SMAD2 Expression can be found in the commercial product lists of the above-referenced companies, such as siRNA products #sc-38374 and #sc-44338 and CRISPR product #sc-400475 from Santa Cruz Biotechnology, RNAi products SR320897, TG309255, TR309255, and TL309255, and CRISPR products KN404604 and KN516271 (Origene), and multiple CRISPR products from GenScript (Piscataway, NJ). It is to be noted that the term can further be used to refer to any combination of features described herein regarding SMAD2 molecules. For example, any combination of sequence composition, percentage identify, sequence length, domain structure, functional activity, etc. can be used to describe an SMAD2 molecule encompassed by the present invention.

The term "p63" or "TP63" refers to a member of the p53 family of transcription factors. The functional domains of p53 family proteins include an N-terminal transactivation domain, a central DNA-binding domain and an oligomerization domain. Alternative splicing of p63 gene and the use of alternative promoters results in multiple transcript variants encoding different isoforms that vary in their functional properties. These isoforms function during skin development and maintenance, adult stem/progenitor cell regulation, heart development and premature aging. Some isoforms have been found to protect the germline by eliminating oocytes or testicular germ cells that have suffered DNA damage. Mutations in p63 gene are associated with ectodermal dysplasia, and cleft lip/palate syndrome 3 (EEC3); split-hand/foot malformation 4 (SHFM4); ankyloblepharon-ectodermal defects-cleft lip/palate; ADULT syndrome (acro-dermato-ungual-lacrimal-tooth); limb-mammary syndrome; Rap-Hodgkin syndrome (RHS); and orofacial cleft 8. P63 acts as a sequence specific DNA binding transcriptional activator or repressor. The isoforms contain a varying set of transactivation and auto-regulating transactivation inhibiting domains thus showing an isoform specific activity. Isoform 2 activates RIPK4 transcription. P63 can be required in conjunction with TP73/p73 for initiation of p53/TP53 dependent apoptosis in response to genotoxic insults and the presence of activated oncogenes. It is involved in Notch signaling by probably inducing JAG1 and JAG2. P63 plays a role in the regulation of epithelial morphogenesis. The ratio of DeltaN-type and TA*-type isoforms can govern the maintenance of epithelial stem cell compartments and regulate the initiation of epithelial stratification from the undifferentiated embryonal ectoderm. P63 is required for limb formation from the apical ectodermal ridge. P63 activates transcription of the p21 promoter. In one embodiment, the human P63 protein has 680 amino acids and a molecular mass of 76785 Da.

The term "p63" or "TP63" is intended to include fragments, variants (e.g., allelic variants), and derivatives thereof. Representative human p63 cDNA and human p63 protein sequences are well-known in the art and are publicly available from the National Center for Biotechnology Information (NCBI). For example, 13 human XBP1 isoforms are known. The p63 transcript variant 1 (NM_003722.5) represents the longest transcript and encodes the longest isoform, p63 isoform 1 (NP_003713.3). The p63 transcript variant 2 (NM_001114978.2) lacks an exon in the 3' coding region that results in a frameshift, compared to variant 1. The resulting isoform (2, also known as TAp63beta and TA-beta; NP_001108450.1) is shorter and has a distinct C-terminus, compared to isoform 1. The p63 transcript variant 3 (NM_001114979.2) differs in the 3' UTR and coding region, compared to variant 1. The resulting isoform (3, also known as TAp63gamma, TA-gamma, and p51A; NP_001108451.1) is shorter and has a distinct C-terminus, compared to isoform 1. The p63 transcript variant 4 (NM_001114980.2) differs in the 5' UTR and coding region, compared to variant 1. The resulting isoform (4, also known as deltaNp63alpha, deltaN-alpha, P51delNalpha, CUSP, and p73H; NP_001108452.1) is shorter and has a distinct N-terminus, compared to isoform 1. The p63 transcript variant 5 (NM_001114981.2) differs in the 5' UTR and coding region, and also lacks an exon in the 3' coding region that results in a frameshift, compared to variant 1. The resulting isoform (5, also known as deltaNp63beta, P51delNbeta, and deltaN-beta; NP_001108453.1) is shorter and has distinct N- and C-termini, compared to isoform 1. The p63 transcript variant 6 (NM_001114982.2) differs in the 5' UTR and coding region, and in the 3' UTR and coding region, compared to variant 1. The resulting isoform (6, also known as deltaNp63gamma, P51delNgamma, and deltaN-gamma; NP_001108454.1) is shorter and has distinct N- and C-termini, compared to isoform 1. The p63 transcript variant 7 (NM_001329144.2) lacks two exons in the 3' coding region, which leads to a frameshift compared to variant 1. The encoded isoform (7, also known as TAp63delta, TA-delta, and P51delta; NP_001316073.1) has a shorter and distinct C-terminus, compared to isoform 1. The p63 transcript variant 8 (NM_001329145.2) has multiple differences compared to variant 1. These differences result in the use of an alternate start codon and introduce a frameshift in the 3' coding region. The encoded isoform (8, also known as deltaN-delta; NP_001316074.1) has shorter and distinct N- and C-termini, compared to isoform 1. The p63 transcript variant 9 (NM_001329146.2) lacks several 5' exons, and uses an alternate start codon, compared to variant 1. The encoded isoform (9, also known as deltaNp73L; NP_001316075.1) has a shorter and distinct N-terminus, compared to isoform 1. The p63 transcript variant 10 (NM_001329148.2) uses an alternate in-frame splice site in the central coding region, compared to variant 1. The encoded isoform (10, also known as p63-delta; NP_001316077.1) is shorter than isoform 1.

The p63 transcript variant 11 (NM_001329149.2) has multiple differences compared to variant 1. These differences result in the use of an alternate start codon and introduce a frameshift in the 3' coding region. The encoded isoform (11) (NP_001316078.1) is shorter and has distinct N- and C-termini, compared to isoform 1. The p63 transcript variant 12 (NM_001329150.2) has multiple differences compared to variant 1. These differences result in the use of an alternate start codon and introduce a frameshift in the 3' coding region. The encoded isoform (12) (NP_001316079.1) is shorter and has distinct N- and C-termini, compared to isoform 1. The p63 transcript variant 13 (NM_001329964.1) represents use of an alternate promoter and therefore differs in the 5' UTR and 5' coding region, compared to variant 1. The promoter and 5' terminal exon sequence is from an endogenous retroviral LTR (PMID: 21994760). The resulting isoform (13, also known as GTAp63; NP_001316893.1) is shorter and has a distinct N-terminus, compared to isoform 1. The encoded protein is expressed predominantly in testicular germ cells and eliminates germ cells that have suffered DNA damage. Nucleic acid and polypeptide sequences of p63 orthologs in organisms other than humans are well known and include, for example, chimpanzee p63 (XM_009447014.3 and XP_009445289.1; XM_001160376.5 and XP_001160376.1; XM_009447013.3 and XP_009445288.1; XM_003310173.3 and XP_003310221.1; XM_001160425.5 and XP_001160425.1; X1\4016942495.2 and XP_016797984.1; and XM_001160182.3 and XP_001160182.1); monkey p63 (XM_028843565.1 and XP_028699398.1; XM_015132502.2 and XP_014987988.1; XM_015132501.2 and XP_014987987.1; XM_001092093.3 and XP_001092093.1; XM_028843566.1 and XP_028699399.1; XM_028843567.1 and XP_028699400.1; XM_001091977.4 and XP_001091977.3; XM_015132503.2 and XP_014987989.1; and XM_015132504.2 and XP_014987990.2); dog p63 (XM_022414176.1 and XP_022269884.1; XM_005639826.3 and XP_005639883.1; XM_856247.5 and XP_861340.3; XM_005639828.3 and XP_005639885.1; XM_005639827.2 and XP_005639884.1; XM_856275.3 and XP_861368.1; and XM_022414177.1 and XP_022269885.1), cattle p63 (NM_001191337.1 and NP_001178266.1), mouse p63 (NM_001127259.1 and NP_001120731.1; NM_001127260.1 and NP_001120732.1; NM_001127261.1 and NP_001120733.1; NM_001127262.1 and NP_001120734.1; NM_001127263.1 and NP_001120735.1; NM_001127264.1 and NP_001120736.1; NM_001127265.1 and NP_001120737.1; and NM_011641.2 and NP_035771.1), rat p63 (NM_001127339.1 and NP_001120811.1; NM_001127341.1 and NP_001120813.1; NM_001127342.1 and NP_001120814.1; NM_001127343.1 and NP_001120815.1; NM_001127344.1 and NP_001120816.1; and NM_019221.3 and NP_062094.1), and chicken p63 (NM_204351.1 and NP_989682.1). Representative sequences of p63 orthologs are presented below in Table 1.

Anti-p63 antibodies suitable for detecting p63 protein are well-known in the art and include, for example, antibodies TA323790 and CF811064 (OriGene Technologies, Rockville, MD), AF1916 (antibody from Novus Biologicals, Littleton, CO), ab124762, ab53039, and ab735, ab97865 (antibodies from AbCam, Cambridge, MA), etc. In addition, reagents are well-known for detecting p63 expression. Moreover, multiple siRNA, shRNA, CRISPR constructs for reducing p63 Expression can be found in the commercial product lists of the above-referenced companies, such as siRNA products #sc-36620 and #sc-36621 from Santa Cruz Biotechnology, RNAi products TR308688, TG308688, TL308688, and SR322466, and CRISPR products KN208013 and KN208013BN (Origene), and multiple CRISPR products from GenScript (Piscataway, NJ). It is to be noted that the term can further be used to refer to any combination of features described herein regarding p63 molecules. For example, any combination of sequence composition, percentage identify, sequence length, domain structure, functional activity, etc. can be used to describe an p63 molecule encompassed by the present invention.

The term "TP53" refers to Tumor Protein P53, a tumor suppressor protein containing transcriptional activation, DNA binding, and oligomerization domains. The encoded protein responds to diverse cellular stresses to regulate expression of target genes, thereby inducing cell cycle arrest, apoptosis, senescence, DNA repair, or changes in metabolism. Mutations in this gene are associated with a variety of human cancers, including hereditary cancers such as Li-Fraumeni syndrome. TP53 mutations are universal across cancer types. The loss of a tumor suppressor is most often through large deleterious events, such as frameshift mutations, or premature stop codons. In TP53 however, many of the observed mutations in cancer are found to be single nucleotide missense variants. These variants are broadly distributed throughout the gene, but with the majority localizing in the DNA binding domain. There is no single hotspot in the DNA binding domain, but a majority of mutations occur in amino acid positions 175, 245, 248, 273, and 282 (NM_000546). While a large proportion of cancer genomics research is focused on somatic variants, TP53 is also of note in the germline. Germline TP53 mutations are the hallmark of Li-Fraumeni syndrome, and many (both germline and somatic) variants have been found to have a prognostic impact on patient outcomes. TP53 acts as a tumor suppressor in many tumor types by inducing growth arrest or apoptosis depending on the physiological circumstances and cell type. TP53 is involved in cell cycle regulation as a trans-activator that acts to negatively regulate cell division by controlling a set of genes required for this process. One of the activated genes is an inhibitor of cyclin-dependent kinases. Apoptosis induction seems to be mediated either by stimulation of BAX and FAS antigen expression, or by repression of Bcl-2 expression. In cooperation with mitochondrial PPIF, TP53 is involved in activating oxidative stress-induced necrosis, and the function is largely independent of transcription. TP53 induces the transcription of long intergenic non-coding RNA p21 (lincRNA-p21) and lincRNA-Mkln1. LincRNA-p21 participates in TP53-dependent transcriptional repression leading to apoptosis and seem to have to effect on cell-cycle regulation. TP53 is implicated in Notch signaling cross-over. TP53 prevents CDK7 kinase activity when associated to CAK complex in response to DNA damage, thus stopping cell cycle progression. Isoform 2 of TP53 enhances the transactivation activity of isoform 1 from some but not all TP53-inducible promoters. Isoform 4 of TP53 suppresses transactivation activity and impairs growth suppression mediated by isoform 1. Isoform 7 of TP53 inhibits isoform 1-mediated apoptosis. TP53 regulates the circadian clock by repressing CLOCK-ARNTL/BMAL1-mediated transcriptional activation of PER2 (Miki et al., (2013) *Nat Commun* 4:2444). In some embodiments, human TP53 protein has 393 amino acids and a molecular mass of 43653 Da. The known binding partners of TP53 include, e.g., AXIN1, ING4, YWHAZ, HIPK1, HIPK2, WWOX, GRK5, ANKRD2, RFFL, RNF 34, and TP53INP1.

The term "TP53" is intended to include fragments, variants (e.g., allelic variants), and derivatives thereof. Representative human TP53 cDNA and human TP53 protein sequences are well-known in the art and are publicly available from the National Center for Biotechnology Information (NCBI). For example, at least 12 different human TP53 isoforms are known. Human TP53 isoform a (NP_000537.3, NP_001119584.1) is encodable by the transcript variant 1 (NM_000546.5) and the transcript variant 2 (NM_001126112.2). Human TP53 isoform b (NP_001119586.1) is encodable by the transcript variant 3 (NM_001126114.2). Human TP53 isoform c (NP_001119585.1) is encodable by the transcript variant 4 (NM_001126113.2). Human TP53 isoform d (NP_001119587.1) is encodable by the transcript variant 5 (NM_001126115.1). Human TP53 isoform e (NP_001119588.1) is encodable by the transcript variant 6 (NM_001126116.1). Human TP53 isoform f (NP_001119589.1) is encodable by the transcript variant 7 (NM_001126117.1). Human TP53 isoform g (NP_001119590.1, NP_001263689.1, and NP_001263690.1) is encodable by the transcript variant 8 (NM_001126118.1), the transcript variant 1 (NM_001276760.1), and the transcript variant 2 (NM_001276761.1). Human TP53 isoform h (NP_001263624.1) is encodable by the transcript variant 4 (NM_001276695.1). Human TP53 isoform i (NP_001263625.1) is encodable by the transcript variant 3 (NM_001276696.1). Human TP53 isoform j (NP_001263626.1) is encodable by the transcript variant 5 (NM_001276697.1). Human TP53 isoform k (NP_001263627.1) is encodable by the transcript variant 6 (NM_001276698.1). Human TP53 isoform 1 (NP_001263628.1) is encodable by the transcript variant 7 (NM_001276699.1). Nucleic acid and polypeptide sequences of TP53 orthologs in organisms other than humans are well known and include, for example, chimpanzee TP53 (XM_001172077.5 and XP_001172077.2, and XM_016931470.2 and XP_016786959.2), monkey TP53 (NM_001047151.2 and NP_001040616.1), dog TP53 (NM_001003210.1 and NP_001003210.1), cattle TP53 (NM_174201.2 and NP_776626.1), mouse TP53 (NM_001127233.1 and NP_001120705.1, and NM_011640.3 and NP_035770.2), rat TP53 (NM_030989.3 and NP_112251.2), tropical clawed frog TP53 (NM_001001903.1 and NP_001001903.1), and zebrafish TP53 (NM_001271820.1 and NP_001258749.1, NM_001328587.1 and NP_001315516.1, NM_001328588.1 and NP_001315517.1, and NM_131327.2 and NP_571402.1). Representative sequences of TP53 orthologs are presented below in Table 1.

Anti-TP53 antibodies suitable for detecting TP53 protein are well-known in the art and include, for example, antibodies TA502925 and CF502924 (Origene), antibodies NB200-103 and NB200-171 (Novus Biologicals, Littleton, CO), antibodies ab26 and ab1101 (AbCam, Cambridge, MA), antibody 700439 (ThermoFisher Scientific), antibody 33-856 (ProSci), etc. In addition, reagents are well-known for detecting TP53. Multiple clinical tests of TP53 are available in NIH Genetic Testing Registry (GTR®) (e.g., GTR Test ID: GTR000517320.2, offered by Fulgent Clinical Diagnostics Lab (Temple City, CA)). Moreover, multiple siRNA, shRNA, CRISPR constructs for reducing TP53 expression can be found in the commercial product lists of the above-referenced companies, such as siRNA products #sc-29435 and sc-44218, and CRISPR product #sc-416469 from Santa Cruz Biotechnology, RNAi products SR322075 and TL320558V, and CRISPR product KN200003 (Origene), and multiple CRISPR products from GenScript (Piscataway, NJ). Chemical inhibitors of TP53 are also available, including, e.g., Cyclic Pifithrin-α hydrobromide, RITA (TOCRIS, MN). It is to be noted that the term can further be used to refer to any combination of features described herein regarding TP53 molecules. For example, any combination of sequence composition, percentage identify, sequence length, domain structure, functional activity, etc. can be used to describe a TP53 molecule encompassed by the present invention.

There is a known and definite correspondence between the amino acid sequence of a particular protein and the nucleotide sequences that can code for the protein, as defined by the genetic code (shown below). Likewise, there is a known and definite correspondence between the nucleotide sequence of a particular nucleic acid and the amino acid sequence encoded by that nucleic acid, as defined by the genetic code.

| GENETIC CODE | |
|---|---|
| Alanine (Ala, A) | GCA, GCC, GCG, GCT |
| Arginine (Arg, R) | AGA, ACG, CGA, CGC, CGG, CGT |
| Asparagine (Asn, N) | AAC, AAT |
| Aspartic acid (Asp, D) | GAC, GAT |
| Cysteine (Cys, C) | TGC, TGT |
| Glutamic acid (Glu, E) | GAA, GAG |
| Glutamine (Gln, Q) | CAA, CAG |
| Glycine (Gly, G) | GGA, GGC, GGG, GGT |
| Histidine (His, H) | CAC, CAT |
| Isoleucine (Ile, I) | ATA, ATC, ATT |
| Leucine (Leu, L) | CTA, CTC, CTG, CTT, TTA, TTG |
| Lysine (Lys, K) | AAA, AAG |
| Methionine (Met, M) | ATG |
| Phenylalanine (Phe, F) | TTC, TTT |
| Proline (Pro, P) | CCA, CCC, CCG, CCT |
| Serine (Ser, S) | AGC, AGT, TCA, TCC, TCG, TCT |
| Threonine (Thr, T) | ACA, ACC, ACG, ACT |
| Tryptophan (Trp, W) | TGG |
| Tyrosine (Tyr, Y) | TAC, TAT |
| Valine (Val, V) | GTA, GTC, GTG, GTT |
| Termination signal (end) | TAA, TAG, TGA |

An important and well-known feature of the genetic code is its redundancy, whereby, for most of the amino acids used to make proteins, more than one coding nucleotide triplet may be employed (illustrated above). Therefore, a number of different nucleotide sequences may code for a given amino acid sequence. Such nucleotide sequences are considered functionally equivalent since they result in the production of the same amino acid sequence in all organisms (although certain organisms may translate some sequences more efficiently than they do others). Moreover, occasionally, a methylated variant of a purine or pyrimidine may be found in a given nucleotide sequence. Such methylations do not affect the coding relationship between the trinucleotide codon and the corresponding amino acid.

In view of the foregoing, the nucleotide sequence of a DNA or RNA encoding a biomarker nucleic acid (or any portion thereof) can be used to derive the polypeptide amino acid sequence, using the genetic code to translate the DNA or RNA into an amino acid sequence. Likewise, for polypeptide amino acid sequences, corresponding nucleotide sequences that can encode the polypeptide can be deduced from the genetic code (which, because of its redundancy, will produce multiple nucleic acid sequences for any given amino acid sequence). Thus, description and/or disclosure herein of a nucleotide sequence which encodes a polypeptide should be considered to also include description and/or disclosure of the amino acid sequence encoded by the nucleotide sequence. Similarly, description and/or disclosure of a polypeptide amino acid sequence herein should be considered to also include description and/or disclosure of all possible nucleotide sequences that can encode the amino acid sequence.

Finally, nucleic acid and amino acid sequence information for the loci and biomarkers encompassed by the present invention and related biomarkers (e.g., biomarkers listed in Tables 1 and 2) are well known in the art and readily available on publicly available databases, such as the National Center for Biotechnology Information (NCBI). For example, exemplary nucleic acid and amino acid sequences derived from publicly available sequence databases are provided below.

TABLE 1

Smad1

Smad2

Smad3

Smad4

Smad5

Smad9

P53

P63

P73

SEQ ID NO: 1 Human Smad2 transcript variant 2 mRNA Sequence
NM_001003652.4; CDS: 127-1530)

```
   1 aggcgggtct acccgcgcgg ccgcggcggc ggagaagcag ctcgccagcc agcagcccgc
  61 cagccgccgg gaggttcgat acaagaggct gttttcctag cgtggcttgc tgcctttggt
 121 aagaacatgt cgtccatctt gccattcacg ccgccagttg tgaagagact gctgggatgg
 181 aagaagtcag ctggtgggtc tggaggagca ggcggaggag agcagaatgg gcaggaagaa
 241 aagtggtgtg agaaagcagt gaaaagtctg gtgaagaagc taaagaaaac aggacgatta
 301 gatgagcttg agaaagccat caccactcaa aactgtaata ctaaatgtgt taccatacca
 361 agcacttgct ctgaaatttg ggactgagt acaccaaata cgatagatca gtgggataca
 421 acaggccttt acagcttctc tgaacaaacc aggtctcttg atggtcgtct ccaggtatcc
 481 catcgaaaag gattgccaca tgttatatat tgccgattat ggcgctggcc tgatcttcac
 541 agtcatcatg aactcaaggc aattgaaaac tgcgaatatg cttttaatct taaaaaggat
 601 gaagtatgtg taaaccctta ccactatcag agagttgaga caccagtttt gcctccagta
 661 ttagtgcccc gacacaccga gatcctaaca gaacttccgc ctctggatga ctatactcac
 721 tccattccag aaaacactaa cttcccagca ggaattgagc cacagagtaa ttatattcca
 781 gaaacgccac ctcctggata tatcagtgaa gatggagaaa caagtgacca acagttgaat
 841 caaagtatgg acacaggctc tccagcagaa ctatctccta ctactctttc ccctgttaat
 901 catagcttgg atttacagcc agttacttac tcagaacctg cattttggtg ttcgatagca
 961 tattatgaat taaatcagag ggttggagaa accttccatg catcacagcc ctcactcact
1021 gtagatggct ttacagaccc atcaaattca gagaggttct gcttaggttt actctccaat
1081 gttaaccgaa atgccacggt agaaatgaca agaaggcata taggaagagg agtgcgctta
1141 tactacatag gtggggaagt tttgctgag tgcctaagtg atagtgcaat ctttgtgcag
1201 agccccaatt gtaatcagag atatggctgg caccctgcaa cagtgtgtaa aattccacca
1261 ggctgtaatc tgaagatctt caacaaccag gaatttgctg ctcttctggc tcagtctgtt
1321 aatcagggtt ttgaagccgt ctatcagcta actagaatgt gcaccataag aatgagtttt
1381 gtgaaagggt ggggagcaga ataccgaagg cagacggtaa caagtactcc ttgctggatt
1441 gaacttcatc tgaatggacc tctacagtgg ttggacaaag tattaactca gatgggatcc
1501 ccttcagtgc gttgctcaag catgtcataa agcttcacca atcaagtccc atgaaaagac
1561 ttaatgtaac aactcttctg tcatagcatt gtgtgtggtc cctatggact gtttactatc
1621 caaaagttca agagagaaaa cagcacttga ggtctcatca attaaagcac cttgtggaat
1681 ctgtttccta tatttgaata ttagatggga aaattagtgt ctagaaatac tctcccatta
1741 aagaggaaga gaagatttta aagacttaat gatgtcttat tgggcataaa actgagtgtc
1801 ccaaaggttt attaataaca gtagtagtta tgtgtacagg taatgtatca tgatccagta
1861 tcacagtatt gtgctgttta tatacatttt tagtttgcat agatgaggtg tgtgtgtgcg
1921 ctgcttcttg atctaggcaa acctttataa agttgcagta cctaatctgt tattcccact
1981 tctctgttat ttttgtgtgt ctttttttaat atataatata tatcaagatt ttcaaattat
2041 ttagaagcag attttcctgt agaaaaacta atttttctgc cttttaccaa aaataaactc
2101 ttgggggaag aaaagtggat taacttttga aatccttgac cttaatgtgt tcagtggggc
2161 ttaaacagtc attcttttg tggtttttg ttttttttg tttttttttt taactgctaa
2221 atcttattat aaggaaacca tactgaaaac ctttccaagc ctcttttttc cattcccatt
2281 tttgtcctca taatcaaaac agcataacat gacatcatca ccagtaatag ttgcattgat
2341 actgctggca ccagttaatt ctgggataca gtaagaattc atatggagaa agtccctttg
2401 tcttatgccc aaatttcaac aggaataatt ggcttgtata atctagcagt ctgttgattt
```

TABLE 1-continued

| | | | | | | |
|---|---|---|---|---|---|---|
| 2461 | atccttccac | ctcataaaaa | atgcataggt | ggcagtataa | ttattttcag | ggatatgcta |
| 2521 | gaattacttc | cacatattta | tcccttttta | aaaaagctaa | tctataaata | ccgtttttcc |
| 2581 | aaaggtattt | tacaatattt | caacagcaga | ccttctgctc | ttcgagtagt | ttgatttggt |
| 2641 | ttagtaacca | gattgcatta | tgaaatgggc | cttttgtaaa | tgtaattgtt | tctgcaaaat |
| 2701 | acctagaaaa | gtgatgctga | ggtaggatca | gcagatatgg | gccatctgtt | tttaaagtat |
| 2761 | gttgtattca | gtttataaat | tgattgttat | tctacacata | attatgaatt | cagaatttta |
| 2821 | aaaattgggg | gaaaagccat | ttatttagca | agttttttag | cttataagtt | acctgcagtc |
| 2881 | tgagctgttc | ttaactgatc | ctggttttgt | gattgacaat | atttcatgct | ctgtagtgag |
| 2941 | aggagatttc | cgaaactctg | ttgctagttc | attctgcagc | aaataattat | tatgtctgat |
| 3001 | gttgactcat | tgcagtttaa | acatttcttc | ttgtttgcat | cttagtagaa | atggaaaata |
| 3061 | accactcctg | gtcgtctttt | cataaatttt | catattttg | aagctgtctt | tggtacttgt |
| 3121 | tctttgaaat | catatccacc | tgtctctata | ggtatcattt | tcaatacttt | caacatttgg |
| 3181 | tggttttcta | ttgggtactc | cccatttccc | tatatttgtg | tgtatatgta | tgtgttcatg |
| 3241 | taaatttggt | atagtaattt | tttattcatt | caacaaatat | ttattgttca | cctgtttgta |
| 3301 | ccaggaactt | ttcttagtct | ttgggtaaag | gtgaacaaga | caactacagt | tcctgccttt |
| 3361 | gctgagacag | cagttacact | aacccttaat | tatcttactt | gtctatgaag | gagataaaca |
| 3421 | gggtactgta | ctggagaata | acagatggga | tgcttcaggt | aggacatcaa | ggaaagcctc |
| 3481 | taaggaaagg | atgcatgagc | taacacctga | cattaaagaa | gcaagccaag | tgaggagcca |
| 3541 | ggggagataa | gcattcctgg | caaagagaat | agcatcaaat | gcaaaaaggt | tcacactaaa |
| 3601 | ggaaactcct | gattaggtat | taatgcttta | tacagaaacc | tctatacaaa | tccaaacttg |
| 3661 | aagatcagaa | tggttctaca | gttcataaca | ttttgaaggt | ggccttattt | tgtgatagtc |
| 3721 | tgcttcatgt | gattctcact | aacatatctc | cttcctcaac | ctttgctgta | aaaatttcat |
| 3781 | ttgcaccaca | tcagtactac | ttaatttaac | aagcttttgt | tgtgtaagct | ctcactgttt |
| 3841 | tagtgccctg | ctgcttgctt | ccagactttg | tgctgtccag | taattatgtc | ttccactacc |
| 3901 | catcttgtga | gcagagtaaa | tgtcctaggt | aataccacta | tcaggcctgt | aggagatact |
| 3961 | cagtggagcc | tctgcccttc | tttttcttac | ttgagaactt | gtaatggtgt | tagggaacag |
| 4021 | ttgtaggggc | agaaaacaac | tctgaaagtg | gtagaaggtc | ctgatcttgg | tggttactct |
| 4081 | tgcattactg | tgttaggtca | agcagtgcct | actatgctgt | ttcagtagtg | gagcgcatct |
| 4141 | ctacagttct | gatgcgattt | ttctgtacag | tatgaaattg | ggactcaact | ctttgaaaac |
| 4201 | acctattgag | cagttatacc | tgttgagcag | tttacttcct | ggttgtaatt | acatttgtgt |
| 4261 | gaatgtgttt | gatgcttttt | aacgagatga | tgtttttgt | attttatcta | ctgtggcctg |
| 4321 | attttttttt | tgttttctgc | ccctcccccc | atttataggt | gtggttttca | tttttctaag |
| 4381 | tgatagaatc | ccctctttgt | tgaatttttg | tctttattta | aattagcaac | attacttagg |
| 4441 | atttattctt | cacaatactg | ttaattttct | aggaatgatg | acctgagaac | cgaatggcca |
| 4501 | tgctttctat | cacatttcta | agatgagtaa | tattttttcc | agtaggttcc | acagagacac |
| 4561 | cttgggggct | ggcttagggg | aggctgttgg | agttctcact | gacttagtgg | catatttatt |
| 4621 | ctgtactgaa | gaactgcatg | gggtttcttt | tggaaagagt | ttcattgctt | taaaaagaag |
| 4681 | ctcagaaagt | ctttataacc | actggtcaac | gattagaaaa | atataactgg | atttaggcct |
| 4741 | accttctgga | ataccgctga | ttgtgctctt | tttatcctac | tttaaagaag | ctttcatgat |
| 4801 | tagatttgag | ctatatcagt | tataccgatt | ataccttata | atacacattc | agttagtaaa |
| 4861 | catttattga | tgcctgttgt | ttgcccagcc | actgtgatgg | atattgaata | ataaaaagat |
| 4921 | gactaggacg | gggccctgac | ccttgagctg | tgcttggtct | tgtagaggtt | gtgttttttt |
| 4981 | tcctcaggac | ctgtcacttt | ggcagaagga | aatctgccta | atttttcttg | aaagctaaat |
| 5041 | tttctttgta | agtttttaca | aattgtttaa | tacctagttg | tattttttac | cttaagccac |
| 5101 | attgagtttt | gcttgatttg | tctgtctttt | aaacactgtc | aaatgctttc | ccttttgtta |
| 5161 | aaattatttt | aatttcactt | tttttgtgcc | cttgtcaatt | taagactaag | actttgaagg |
| 5221 | taaaacaaac | aaacaaacat | cagtcttagt | ctcttgctag | ttgaaatcaa | ataaaagaaa |
| 5281 | atatataccc | agttggtttc | tctacctctt | aaaagcttcc | catatatacc | tttaagatcc |
| 5341 | ttctcttttt | tctttaacta | ctaaataggt | tcagcattta | ttcagtgtta | gataccctct |
| 5401 | tcgtctgagg | gtggcgtagg | tttatgttgg | gatataaagt | aacacaagac | aatcttcact |
| 5461 | gtacataaaa | tatgtcttca | tgtacagtct | ttactttaaa | agctgaacat | tccaatttgc |
| 5521 | gccttccctc | ccaagcccct | gcccaccaag | tatctcttta | gatatctagt | ctgtggacat |
| 5581 | gaacaatgaa | tacttttttc | ttactctgat | cgaaggcatt | gatacttaga | catatcaaac |
| 5641 | atttcttcct | ttcatatgct | ttactttgct | aaatctatta | tattcattgc | ctgaatttta |
| 5701 | ttcttccttt | ctacctgaca | acacacatcc | aggtggtact | tgctggttat | cctctttctt |
| 5761 | gttagccttg | tttttttgttt | tttttttttt | tttttgagag | ggagtctcgc | tctgttgccc |
| 5821 | aacctggagt | gcagtggtgc | gatcttggtt | cactgcaagc | tccgcctccc | gggttcacgc |
| 5881 | catgcttctg | cctcagcctc | ccaagtagct | gggactacag | gcgcccacca | ccacactcgg |
| 5941 | ctaatttttt | gtatttttag | tagagacggg | gtttcaccgt | gttggccagg | atggtctcga |
| 6001 | tctcctgacc | tcgtgatctg | tccacctcgg | cttcccaaag | tgctgggatt | acaggcatga |
| 6061 | gccaccgcgc | ccagcctagc | catattttta | tctgcatata | tcagaatgtt | tctctccttt |
| 6121 | gaacttatta | acaaaaaagg | aacatgcttt | tcatacctag | agtcctaatt | tcttcatcat |
| 6181 | gaaggttgct | attcaaattg | atcaatcatt | ttaattttac | aaatggctca | aaaattctgt |
| 6241 | tcagtaaatg | tctttgtgac | tggcaaatgg | cataaattat | gtttaagatt | atgaactttt |
| 6301 | ctgacagttg | cagccaatgt | tttccctacg | ataccagatt | tccatcttgg | ggcatattgg |
| 6361 | attgttgtat | ttaagacagt | cagaataatg | atagtgtgtg | gtctccagag | gtagtcagaa |
| 6421 | tcctgctatt | gagttctttt | tatatcttcc | ttttcaattt | tttattacca | ttttgtttgt |
| 6481 | ttagactaca | ctttgtaggg | attgaggggc | aaattatctc | ttggagtgga | attcctgtgt |
| 6541 | tttgagcctt | acaaccagga | aatatgagct | atactagata | gcctcatgat | agcatttacg |
| 6601 | ataagaactt | atctcgtgtg | ttcatgtaat | tttttgagta | ggaactgttt | tatcttgaat |
| 6661 | attgtagcta | actatatata | gcagaactgc | ctcagtcttt | ttaagaagga | aataaataat |
| 6721 | atatgtgtat | gaatttatat | atacatatac | actcatagac | aaacttaaca | gttggggtca |
| 6781 | ttctaacagt | taaaacaatt | gttccattgt | ttaaatctca | gatcctggta | aaatgttctt |
| 6841 | aatttgtctg | tgtacatttt | cctttcatgg | acagaccatt | ggagtacatt | aattttctta |
| 6901 | atctgccatt | tggcagttca | tttaatatac | cattttttgg | caacttggta | actaagaatc |
| 6961 | acagccaaaa | tttgttaaca | tcaaagaaag | ctctgccata | taccccgtta | ctaaattatt |
| 7021 | atacatccag | cagattctgg | gatgtactaa | cttagggtta | actttgttgt | tgttgataat |
| 7081 | actagattgc | tccctcttta | attcttcttc | tggtgcaagg | ttgctgctta | agttaccctg |
| 7141 | ggaaatacta | ctacaaggtc | aaattttcta | gtatcttaca | gcctgattga | aggtgattca |
| 7201 | gatctttgct | caatataaat | ggattttcca | agattctctg | ggccatcctt | gacccacagg |

TABLE 1-continued

| | | | | | | |
|---|---|---|---|---|---|---|
| 7261 | tgatctcgct | ggagtatatt | aacttaactt | cagtgccagt | tggtttggtg | ccatgagatc |
| 7321 | cataatgaat | ccagaacttc | accattgctt | agatataaga | gtcccttgga | agaataatgc |
| 7381 | cactgatgat | gggggtcaga | aggtgtatta | actcaacata | gagggctttt | agatttttct |
| 7441 | tcaaaaaaat | ttcgagaaaa | gtattctttt | accctccaaa | cagttaacag | ctcttagttt |
| 7501 | ctccaaatat | gctctttgat | ttacttattt | ttaattaaag | atggtaattt | attgaacaat |
| 7561 | gaaatccgta | atatattgat | ttaaggacaa | aagtgaagtt | ttagaattat | aaaagtactt |
| 7621 | aaatattata | tattttccat | ttcataattg | ttttcctttc | tctgtggctt | taaagttttt |
| 7681 | gactatttta | caatgttaat | cactaggtaa | cttgccatat | ttctggttct | atattaagtt |
| 7741 | ctatccttta | taatgctgtt | attataaagc | tggtttttag | catttgtctg | tagcaataga |
| 7801 | aattttacta | agtctctgtt | ctcccagtaa | gtttttttctt | ttctcagtaa | gtccctaaga |
| 7861 | aaacatttgt | ttgccactct | tactattccc | aatcttggat | tgttcgagct | gaaaaaaaat |
| 7921 | ttgatgagaa | acaggaggat | ccttttctgg | tgaatatagg | ttcctgcttt | aagaatgtgg |
| 7981 | aaatccattg | ctttatataa | ctaatataca | cacagattaa | ttaaaattgt | gagaaataat |
| 8041 | tcacacatga | caagtaggta | acatgcatga | gttttgaatt | tttttaaaaa | cccaactgtt |
| 8101 | tgacaaaata | tagaacccaa | attggtactt | tcttagacca | gtgtaacctc | acacctcagt |
| 8161 | tttgcttttc | caaccctgac | ttgaaaggca | tatttgtatc | tttttattag | tgatagtgaa |
| 8221 | gctgtgacac | taacctttta | tacaaaagag | taaagaaaga | aaaactacag | cgattaagat |
| 8281 | gagaacagtt | ctgcagttgt | tgaactagat | cacagcattg | taggcagaat | aaaaaatgtt |
| 8341 | catatctgag | aatattcctt | tcgccatctt | ttcccaaggc | cagacctcct | ggtggagcac |
| 8401 | agttaaaagt | aacattctgg | gcctttgtaa | tcggagggct | gtgtctccag | ctggcagcct |
| 8461 | ttgttttaat | atataatgca | ggactgtgga | aaacagttgg | catagaatat | tttcacctaa |
| 8521 | aaaagaaaga | aaagacatac | aaaactggat | taattgcaaa | aagagaatac | agtaaaatac |
| 8581 | catataactg | gacaaagcta | gaagaacctt | tagaagattt | gtctgaaaac | agatttcaag |
| 8641 | agtgagcttt | tatacactgc | tcactaattt | gcttgattac | taccaactct | tcttaaagtt |
| 8701 | aacacgttta | aggtatttct | ggacttccta | gccttttagc | aagcttagag | gaactagcca |
| 8761 | ttagctagtg | atgtaaaaat | attttgggga | ctgatgccct | taaaggttat | gcccttgaaa |
| 8821 | gttcttacct | tttctctagt | gatattaagg | aacgagtggg | tagtgttctc | agggtgacca |
| 8881 | gctgccctaa | agtgcctggg | attgagggtt | tccctggatg | cgggactttc | cctggataca |
| 8941 | aaacttttag | cagagttttg | tatatatgtg | gatttttctg | ataagtagca | catcagaggc |
| 9001 | cttaaccact | gcccaaaagc | gattctccat | tgagagtaca | tatcttgaac | ttaagaaatt |
| 9061 | catttgctct | gatttttaat | cttgtaaagt | ttttgctaaa | ctcaaaacaa | gtcccaggca |
| 9121 | caccagaagg | agctgaccac | cttaggtgtt | cttgtgattt | atccttactt | ccctatgttg |
| 9181 | tcatagttgc | ttctaaactc | agctgcacta | tggctgtcaa | catttctgat | acttattggg |
| 9241 | atatgtgcca | tccagtcatt | tagtactttg | aatggaacat | gagatttata | acacaggtaa |
| 9301 | tagctgaagg | taccagtatg | gtggtgagac | tcacacttag | tgatccagct | aaggtaactg |
| 9361 | atgttataat | ggaacagaga | agaggccaac | tagatagcta | agttcttctg | aacctatgtg |
| 9421 | tatatgtaag | tacaaatcat | gcgtccttat | ggggttaaac | ttaatctgaa | atttacattt |
| 9481 | ttcatagtaa | aaggaaacca | attgttgcag | atttcttttc | ttgtgaggaa | atacatggcc |
| 9541 | tttgatgctc | tggcgtctac | tgcatttccc | agtctgttct | gctcgagaag | ccagaatgtg |
| 9601 | ttgttaacat | ttttccgtga | atgttgtgtt | aaaatgatta | aatgcatcag | ccaatggcaa |
| 9661 | gtgaaggaat | tgggtgtcct | gatgcagact | gagcagtttc | tctcaattgt | agcctcatac |
| 9721 | tcataaggtg | cttaccagct | agaacattga | gcacgtgagg | tgagattttt | tttctctgat |
| 9781 | ggcattaact | ttgtaatgca | atatgatgga | tgcagaccct | gttcttgttt | ccctctggaa |
| 9841 | gtccttagtg | gctgcatcct | tggtgcactg | tgatggagat | attaaatgtg | ttctttgtga |
| 9901 | gctttcgttc | tatgattgtc | aaaagtacga | tgtggttcct | tttttatttt | tattaaacaa |
| 9961 | tgagctgagg | ctttattaca | gctggttttc | aagttaaaat | tgttgaatac | tgatgtcttt |
| 10021 | ctcccaccta | caccaaatat | tttagtctat | ttaaagtaca | aaaaaagttc | tgcttaagaa |
| 10081 | aacattgctt | acatgtcctg | tgatttctgg | tcaattttta | tatatatttg | tgtgcatcat |
| 10141 | ctgtatgtgc | tttcactttt | taccttgttt | gctcttacct | gtgttaacag | ccctgtcacc |
| 10201 | gttgaaaggt | ggacagtttt | cctagcatta | aaagaaagcc | atttgagttg | tttaccatgt |
| 10261 | tactatggga | ctaattttta | attgttttaa | tttttattta | aactgatctt | tttttatatg |
| 10321 | ggattacatt | ttggtgttca | ctccctaaat | tatatggaaa | ccaaaaaaag | tgattgtatt |
| 10381 | tcacatatgg | acatatgatt | ttaagagtac | atgtttttgt | ttttttaatt | tggtgttaca |
| 10441 | taaaagatta | tcctatcccc | ccgggagata | aatttatact | acttaatata | accccacaac |
| 10501 | aggcgcacac | cacacactgc | acagtgctat | ttatacattt | ttatttattt | cagagtttgc |
| 10561 | ctatgctaca | ttagcgctct | aatacataag | atctatgctg | taaacaaaaa | catcttcaaa |
| 10621 | gttgaaattt | gctgaaatat | acttttaaca | aaataacatt | tttaaggctc | cattgaaaaa |
| 10681 | tactagataa | gatataatct | catataatca | gtatgaataa | ttttaaaaat | gagaaatatt |
| 10741 | taggtcagcc | acacttcctt | tgtgccttgc | aagaattcag | ttctgtggat | gaatcagtac |
| 10801 | tggttagcag | actgttttct | gcaaaccatt | ttaaacatgc | tttagtatgc | aacaaaaagg |
| 10861 | gacctcaaat | gctaaaatac | actattttac | gtggcattga | atagccttgg | gactggtgta |
| 10921 | gttttatcaa | cacttttttta | ttaggaagaa | acccaagaaa | atttactgta | attgctacca |
| 10981 | cctgccactg | tataaataat | ctaaaaggga | cttcccaaca | ttgaacaaca | acattgaggg |
| 11041 | ctgactcgag | atccttctac | attgtcacct | cagcctggct | ttgcctgtca | ctgcttagct |
| 11101 | tgaagtagtg | acactgttct | gtatcaggag | atttttataa | tggccctagc | atccataatt |
| 11161 | ccacatgttc | atcaaatggc | tgaagagtat | gagagaagta | ttaaggtcta | tgtttgggct |
| 11221 | gtctccccac | ttggcatatt | ctgtttttcc | ctcttcaaaa | tagattgaaa | gcctcttagt |
| 11281 | gcaggaagca | ggcatcagta | tcaaactgat | gtcatccaat | gtaattattt | taagctccag |
| 11341 | gtttgtctaa | gtttgggtga | agaatgttca | ggaacatgtt | tgcaacatac | agttatccag |
| 11401 | cttacccttt | gacagattca | cccttctcat | caaaatagta | agcccaacct | aaaaattata |
| 11461 | agtttacaaa | taaaggaata | gaaaaaccca | aaaagctaat | ttacacataa | aaattatctt |
| 11521 | ttgctgcaat | aaataggtat | ggaaatattt | gtagaattgg | tttaactgat | tttgtaaaac |
| 11581 | aaatgtcatg | ctattttgcc | atagtgagac | atgcagtaat | tcttaaaatc | acattaatag |
| 11641 | aaggcaagaa | cattgaatca | gacttagcag | ataacagatt | cagtgataaa | tgaacaatag |
| 11701 | actaagcata | cttaggaagc | tacatgagaa | cagaatgtat | tactgtgctc | ccgtccaaac |
| 11761 | tgcatgactt | tattggttat | agaataaatg | gaatttgaga | tggggatttg | ccagttttta |
| 11821 | cagtctgtct | tcaatagttt | tgttggctgc | ctctgcacct | ttctaaatgt | tatgtgaaaa |
| 11881 | taaaattatt | taagttctaa | agtagtttag | gaaagagatg | tgatgacagg | aaaaagaagt |
| 11941 | taacttctga | acagtttggt | ccaggaagaa | gatgggcaga | atacagtaag | cccagggttg |
| 12001 | aagaatacat | tcaatttgga | gagatggaga | agacctttga | agaaggtcaa | aatgagatct |

TABLE 1-continued 12061 tggaacagaa ctctcacctg tgtgtctgga tatacatgaa aactggacgg tgttattgag
12121 ctactgctta tatggtgagc agaaaattga taaccacaag cctggtaggt tctgctatga
12181 agcccacata taatcacaag gcctagatag cttggagtta aaagccaagg atagctgtat
12241 agtttgggtt ccatagtttg cagtgagatt gtgcttctga gcagtcattt gggggcagtg
12301 gttctgagat tacaagccat aacccagcca agaacgggct acctgtggaa tgaggatgag
12361 gaagttgcta catataaacc ctagtgtgtg tgtgtgtatt aagtgaaact tagttaactt
12421 ttttgctcac agccaaagat gattcatcta gagaagccat tggaatttta gcagagtttt
12481 gtatatatgt ggatttttct aataagtagc aaatcagagg ccttaaccac tgcccaacag
12541 cgattctcca ttgagagtac gtatcttgaa cttaagaaat tcatttgctc tgattttaaa
12601 tcttgtaaag tttttcttca tgagaggtct tgcctctaaa ctatattgtg gcagtatttg
12661 atcaaactac ataagtacca tgtaaataag attttaatac aaatgatgac tcacttctaa
12721 atggtttgcc atttagaaat gtgctgctgt gagaaaaacg aatttttttt tttttttttt
12781 ggagacagag tcttgctctg ttgcccaggc tggggtgcag tggggcgatc tcggctcact
12841 gcagcctcgc ctcctgggtt caagtgattc tcctgcctta gcctcctgag tagctgggat
12901 tacaggcaca caccaccacg cccaactact ttttgtattt ttagtggaga cagggtttca
12961 ccatgtttgc caggctggtc ttgaactcct gacctcagat gatttgcctg cctcggcctc
13021 ccaaagtgct ggaattacag gcgtgagcca tcatgcctgg ctgaaaagtg aaaatttaag
13081 ccagcttacc acctggaata aaaatgtttt ataggaatgt ctaggttgct cttttatatt
13141 gaaaaaaaac ttattagtgt ctgttttacc caagaaccac aagctacttc atttcaactt
13201 ttaaatcatg aataataacg tgttatcacc acatttaaaa atgtacatcg tcaatcacaa
13261 acacatattc taaggaattg aattttatag agataattga atgctttcat ctgtaaaaga
13321 attagtggcc tgcaaaccac tgtggattct tgctatgctt tgaagttgtc agtgggggaa
13381 tttgctgctg caagttactt agacttgtag gcaaagggaa attcaaattt ttaattctaa
13441 aatgaaaacc actgacaaaa ttttatactc tgaaagtttg gttgttagct tagtcattat
13501 tttcctgttc tttatcattt cggaattcag atgcttaaat ttaacataca aattatttgt
13561 tggtaaaaca taaaacataa aaagctacat ttggtaaact aaattttagg attcaaagtc
13621 tctaacaatt tctatgtgac atgtcatacg gtgcagtttt tatttgccaa agtgtctact
13681 tcatactgcc tatgcactgc ttcccgtttt taatctctct accccaaccc ccctataatt
13741 aaataaaccc ctagaaaact gccttctttt agaataccta attgattact ttaaatattt
13801 tttcagaatc aaaattacaa aagggagaga tacctaagaa tctggcttgt ttatattctt
13861 taaaagatcg catttgattg aaggtgggtg catatttttt atatccactc tttccccatt
13921 tgtatgtgac cattgtaaaa gtggatgtgc tttttttttt ttgctgaggt ctagagacaa
13981 tgttttagag atacagaatg aaacatttat gggtaaaata caatgggtaa gacttgcttc
14041 aaaatagtat gtgacagagg aagtagatgg aggtatgaat gaataggaca ttgatggttg
14101 tttgttggga ttgggtaagg gagctttgtt gtattctatt tcctttttaga taagtttgaa
14161 attccttgta gtgaagaaat taaacgtctc catcaggtgc attgccacgt cttctctagg
14221 aagcctcctt aacatcctct ggtggctcct gaactttttc tgttctcatt cacagggaag
14281 ctcatggggc tgcctggaga cttgaggtta catcttgcct agtattacca aaattgtgat
14341 actttctcc accccataat agcacagtct ttggtctcaa cttgaactaa agtctttttt
14401 tttttttttt tttttttttt tagtatttat tgatcattct tgggtgtttc tcggagaggg
14461 ggatgtggca gggtcatagg acaatagtgg agggaaggtc agcagataaa catgtgaaca
14521 agggtctctg gttttcctag gcagaggacc ctgcggcctt ctgcagtgtt tgtgtccctg
14581 ggtacttgag attaaggagt ggtgatgact cttaacgagc atgctgcctt caagcatctg
14641 tttaacaaag cacatcttgc accgcccctta atccatttaa ccctgagtgg acacagcaca
14701 tgtttcagag agcacggggt tgggggtaag gttatagatt aacagcatcc caaggcagaa
14761 gaatttttcc tagtacagaa caaaatggag tctcctatgt ctacttcttt ctacacagac
14821 acagcaacaa tctgatctct ctttcctttc cccacatttc cccttttctt attcgacaaa
14881 accgccatcg tcatcatggc ccgctctcaa tgagctgttg ggtacacctc ccagacaggg
14941 tggcggccgg gcagaggggc tcctcacttc ccagacgggg cggctgggca gaggcgcccc
15001 cccacctccc ggacggggtg gatgctggcc gggggctgcc ccccacctcc cgaacggggc
15061 agctggccgg gcgggggttg ccccccacct cccggacggg gcggctggcc gagcaggggc
15121 tgcccccccac ctccctccca gacggggcgg ctgctgggcg gagacgctcc ttacttcccg
15181 gacggggtgg ttgctgggcg gaggggctcc tcacttctca gacggggcgg ccgggcagag
15241 acgctcctca cctcccagac ggggtggcgg tcgggcagag acactcctca catcccagac
15301 ggggcggcgg ggcagaggcg ctccccacat ctcagacgat gggcggccgg gaagaggcgc
15361 tcctcacttc ccagactggg cggccgggct gaggggctcc tcacatccca gacgatgggc
15421 agccaggcag agatgctcct cacttcccag acggggtggc ggccgggcag aggctgcaat
15481 ctccgcactt tgggaggcca aggcaggcgg ctgggaggtg gaggttgtag cgagccgaga
15541 tcgtgccact gcactccagc ctgggcaaca ttgagcactg agtgagcgag actccatctg
15601 caatcccagc acctcgggag gcccaggcgg gcagatcatg cgcggtcagg agctggagac
15661 cagcctggcc aacacggcga aaccccgtct ccaccaaaaa atacaaaaac cagtcaggcg
15721 tggcggcgcg cgtctgcaat cccaggcact cggcaggctg aggcaggaga atcaggcagg
15781 gaggttgcag tgagccgaga tggcggcagt acagtccagc cttggctcgg catcagaggg
15841 agacggtgga aagtgggaga ccgtagaaag tgggagacgg ggggagacgg gagagggaga
15901 gggatgtgct ttttttctaa ccgttattgc caccaagtaa taatgtctta attcacaatt
15961 tacatagtga ttggctggag agaggtattg agcataaatt tttttttaag attcaactgg
16021 gaaatggatg atttacatga ttttagtctc tttagttgtc tgggtatttc ttgactggga
16081 atagcaatat cttaaaggcc atttttaaca agaatgctaa ggatggaaca cttgaaggaa
16141 gcagtcctgt acagtcaaat acttcagtta ccttggataa tagaatgaaa actcaattgc
16201 ctactttgaa caaatttttt ttttggattt taatggctgg acagaataac attctgctaa
16261 ttttaatcct tggtcatttc cgatgtaatg gaaaatgcag tttgactcag aatcggaggc
16321 ctggggtttg gaccctgatt gtgccaattt atgtgacttt agataaatct tttcatcagt
16381 ctaccttaaa gttcttcatt tcctccagtt ccctaaaatg aggaagttag tttttagggt
16441 ggttatgaga actaaatgag agcacttgag agatcattca gcctgaagtg ggtactcagt
16501 attagatggc taaatctgca cagtctagaa taccaggcaa aggttactct gaaggtcttt
16561 gctaataaca aatctttctc taagaaagtt tgtaaatgtg atgttaaact cagaaatgtc
16621 acatagaaca tattggagca attattgccg caaaagtaac tcgtagcaac cacaaaaacc
16681 cagtggtgtg cagcaataaa cagtttatga attagataag tgatttcggc tagatgtctc
16741 tggagcagtt gtagtctttc ctcgttcatg agggagttgg cctcacctgg aaggacttgg
16801 catttttcca catgcctcct atcctccatt aaacaagcat gtttttgtgg aggttgtaga TABLE 1-continued

```
16861 aggcaacaac agccaagccc aatcccataa ctccctttca tgtctgcatg cttcatgcta
16921 actagcattc accagaaaca agccacatgg ctaaacccag tgtggaaagg cactacagag
16981 ttattagacc aagggagaga acataggagg ggtgaagaat tggagcctta aatgcagtca
17041 atctaccaca cccttgcttt gtatttaaca ggttactgta ctggtttgcc agcaaacaat
17101 ggaaaatgtg gagaagctga agaatgctca agctgggact taatagagtg gcctatttgg
17161 tttgaaatgt tttaacttac agagcattga gtagaagcct aatctaatat acataaggaa
17221 gacaaaagca aaggattgtg ttttctatct aaaggttaat cattgtggtt gctcctggcc
17281 attatcacat gactggaagt taacactctc caaacgctga gcctatcctg tacagcacta
17341 gaaagtagaa agaatcactc aattcaggga aaccgttttc tcttaatgtg aacatttaca
17401 ttaatgccat ttccaaaacc tttctgggac ttcttaaatg caaagatgct atctgcttta
17461 cttcatgctg cctgttttta ggagcttgga gtgctttagg aagcttccca atactggttt
17521 agcagtaatt tggttgactg atcaaggcat gttttaactt tgacactgaa attttaaaaa
17581 gacaacagtt atcttgcccg gagagtcaag tttctgcttc caaggaggtc aggaattgtt
17641 ctctttggtg atgtggctgt gcttggtagc ccttgaaagt ggagtcgaca gcagtcctca
17701 gcttttgtgt gcctgtctta gtctgttttg tgttactata acaggatagc tgaggcaggg
17761 tcacttatga aggatgctca cagttctaca ggctgggaag ttcaagggca tggccctggc
17821 ttttggcaag ggctttgctg ctgcttcata gcttgatgga gaaggtcaga ggggaagcag
17881 acgtgcaaac aacccacttg ttcacaacaa ccaaacaagt ctctttttaa caacccactc
17941 ctggggacta atctagtctt gagagagtga gaactcattg caagagcagc accaagccat
18001 tcatgaagca tctgcctcag tgaaccaaac atctcccact aggccccagc tctcaacacc
18061 accacaatga agataaaatc tcatcataca tttgagggac agtttgggag acagaccata
18121 gcagtgctca gtatttctac ccaaatgttc aggtaactta atatattttt ccttgaatat
18181 atgtttaaat gggcttccct tccccacgct catcttgaat ggtcccacaa caacttttga
18241 ttatcacgtt cctgtaaata cacaaaaata ttttgtggtc ttttactggc agcccagtgg
18301 atgggacttt aaaaaatcac ccagattcca acaaccagag aaaacgactg gtgtatattt
18361 tttccagtct ttatttgtat gtctgtgtat attcaatgga aaatgtttga agcttcactc
18421 acagcacatt ccattagaga aagctactaa aatcataagg aaaatctaaa atgcagtaag
18481 ccagtcagca agccataatg ggcatatgaa aacaaagttt tttgccatga tttgtggacc
18541 acagaagatc tgtgttatta gtctatttaa gtttggtgtt tgaaattaaa aatgttcgac
18601 atacttttta tgttttttt aaatatactg tctatattta aaattgagta tactgtactt
18661 tagtgtgttt ggaagcagat atccccaaat aaaagtatac agtagaacca aagaatttta
18721 ttgatcagct agaatttagt tttcaggtgt aataactgtc aacctaaata acagaggctt
18781 tctaaaagaa aatgatgttt atttgggaat agggcattgt gaaggcaata tgcatgccat
18841 agtaaactgt gtgtattcag gaaggtaaag gaagacaggt ttttaaagga cagataaaga
18901 ttatataatt gtcttgaaat aattattctt ggctacaagg attaataaca aggatgctgc
18961 cagttcgggt ttggacaatc ggcttctagg cagatgtccc aaaagtattt tctgtgtaag
19021 gttgcgaata gtgtttgtgc aagctggcgt ggtttcttct gggtctttga ggtagtgcgt
19081 aaaatccctc tcttcatgga cttccctggc tccatttgtc agggcttttg gaaacatgac
19141 tcttgattct gacagctttc acctttccct ctcttgatga agatgttttt ccgaaagtat
19201 ctatgatgaa tcatcttgta gttaggcttt gattgtccct tggtgacaga atagaccttt
19261 cccgggttat tggtctggtc ctgcatcctg cattggcagg agtgattggc aactaaaagt
19321 cagtgttaaa acccttttag ccacctttga gggcagggag gctttaaggg agtggcactt
19381 aggctaagtc cacctggagt ctattattaa gtccaatttt ttttccttag tcctttgttg
19441 tcccctcaaa gtgctgggct agcattattc tgttaggaat tgtacttctt tctgcagaaa
19501 atttggcaaa taacagatac aaagtttaaa aaggaaatac acaaaattaa tagtaatgtg
19561 acaatcccag tttgcataat ggttttgagc cctgaaccta ggcttacagg caaccaattg
19621 aataaatcaa attgtaatac aattcttgct ctgatgtctt aggaaaaatg tctacagcct
19681 gaaatcatca actttttgtc ctggtttgca gtttgaatgt ctctagctat ggcattggtt
19741 ggtatggtga actttgtgt gacccataca tcagcatgag acttgctcct ttaaaaatta
19801 atcacatctt agcttatagg cctcagagca tgggagtagt tttttttctt agagagtcat
19861 agccaaatat tgaaggaaat taggaggatt caggagcaaa tccagtctgc aggtggataa
19921 caggagtttc aaaacggtac agagctgtga tctaataaca ggtacatata gctttcttca
19981 gaaacttaaa gttaccctga tttttaccaa agatgttcag aataaaacag atttgtaaac
20041 tttatcagat tttgtctgca agaatagtag tatggtcaca gtaatctcag atttaaaaac
20101 ctccttgagg ctaagaagct aagtcaaggt agactttaga ttttacctat agttttaagg
20161 ttcctgggcc tgccaggaaa tgataatttt taattcagtg taatgctgag aaccattgaa
20221 gccaggcatt ctacacattc tcaaatatga cattttaatc aaagccttgg taatacaacc
20281 agtgtttcca attgtatcct gttataacga gagccgattt ttattgaact taggcaaatc
20341 atattgcctt aagagtactc acaaataggc tgggcacagt ggctcatgcc tgtaatccca
20401 gctctttggg aggccaagac aggtggaaca cctgaggtca ggagtttgaa accagcctgg
20461 ccaacatagt gaaacctccc cccggccacc gtctctacta aaaaatacaa aaattagctg
20521 ggtgtggtgg tgcatgcctg tagtcccagc tacttgggag gctgagacag aattgcttga
20581 accctggagg cagaagttgc actgaaacaa gatcgtgcca ctgcattcca gctggggcaa
20641 cagagcgaga ctccgtctca aaaacaaaaa caaatgaata ctcaaaatag tttccaaatt
20701 ggagggatca agaagaaagg aaaagcaaat atttctacct ttgttcacaa aagtattcca
20761 aattgctgta aactatagat agcatgagag aatttcttta aatatggaaa acaaaacatt
20821 taagtaaaaa aacaataatg cttcaaataa aagtcacaga cacatcttca gttacttagt
20881 ctcatgtaac tttttttgtt gtggttgatc ttaattagta gttacatgga ctcatcagtt
20941 tcttgaagtt ctgaaaaaat atttagtcca ttggtattaa agtgattagt aacctgtatt
21001 taaaagtgtg ttagcatctt ttccatgaat ctgattgcaa atgcttttag agaaaaagca
21061 ataactggga attacaaaaa cttagaataa ccatgattaa aaatctgatg agagtttacc
21121 ataaccagaa atagacaaag agttttggtt atttttgtgg caaacagcat aatcagaatt
21181 atgactgatg acatatttct aacggcatcg tacaatttg gaacactcat atcaataaca
21241 tactcataaa tgtaactgtg tctagtatta catcattaga caatgctttt catacaattt
21301 aatacatcaa agaagcctaa ttagctaaca tctctaccag atggcataca catgctctga
21361 ggctttccag aggcccaagt ggaaaactca aaggtaattt taagtcaaaa acacttaatt
21421 tagaacttga gcctagagaa gcctgtcaaa gatgtcaaaa gttcgaaaca ggatcacagg
21481 tcactataaa atatttaaca agaatgataa tcaaaagact taagaagcaa tgcagaaagt
21541 tacatacatt taaaaaccat cttttcaaag cttcattttt cccaagcaaa aaaaaaactt
21601 aaacacaaga atttatcttg atagaacata aaatttttct taggccagtt gccaaaatgg
```

TABLE 1-continued

```
21661 taaagaaaaa tctcttgcag tgtgactgcc tttacttatg ggaagcctat ttggatatac
21721 tgaaagttga atctgatgaa aaggtacttg aatttaatca gacacaggaa gagtatttcc
21781 aaggttatga gtgtacgcct tatagaggaa tgtaaataag aaagctagta tgttgaacag
21841 aatacatggc tcttggaaaa attacgagaa atttcctgct tgcgtggaac aattcaaaca
21901 tgagaagagc caagaattca gaatcaagtt atactggagg aaaacattgc ttttctaggc
21961 cttctacaga acatttcagt atcaagttat aacagcaaga gttagaacca gaggaaaaaa
22021 gttacaggag ctaatgaaaa agttaagagt tatcacccct gccaaacaaa aagatgtacc
22081 ttcttaaggg gagaaagagc taaaggcaat gatgtgtgac ctacaaataa ggtgcagcaa
22141 gatacagcaa aggttgaact tgtgagatat aaatcaggat cttcaagaag aaaactctac
22201 ctcaagaaat gaaatgacca tcttaaatga aaaaagacag cctttctaac ctgaatctag
22261 gggaaattaa acggatctca gaaggaaata tggcagaaat ttaaactgtg gtttagaaga
22321 tggctgattt tagaattaaa aattaaaacc tctttcaatt ttattaagac cagatcctta
22381 aaaagaacct tgttctaaca ttggggacca aattttgtgt gtgtgtgtgt gtgtgtgtgt
22441 gtgtgtgtgt gtgtgtgtgt atagtgcatg tatagcattt acactatcgt gtatatacaa
22501 atatatagca tatgtataga atatactgta ttattgtaca tatacatatg tacaagtata
22561 tatgtaagct caatgtctta tgatttcatt ctgacctatt gccaacttca ttacacacaa
22621 ctcctttcat aaatgtatcc ttcatgaaca tttcatgatc tgcacagacc ttcagtgaca
22681 tgcttaaact ttctgctttg ttttatactt ccccttaaac aactggtcat cctgctttag
22741 gataaaaagt tactatgcaa gactcataca gaattattct gttaattttg taaccttcct
22801 taccaaaggt acattctcac acccattaac ttccttcata tttctctcct cctcctactt
22861 agtggttcct ttctgtcttg tttccatatt tgaaacaacc tctaataaac tctgaattta
22921 aacaactttt ttcccaataa aaagcaattt ttatgcctta taacttttct catcaaaaca
22981 tcttttttg ggtacacttt gtatatggaa ttgtgtattt tcaaatttta acttattaac
23041 cttaattttt agtgaaaacc taggaagcaa aattttgaag tgttatatca gcattttata
23101 aatgagaaac atattataat ttttagaaac atgtttcctt ataactttgt atattaatag
23161 gcccaaatat atttagtctt tctataattt aggaagccaa gaacaaacta atattttcag
23221 cagtttattg tttttttttg gaaatgatcc agacatttac tgaagattaa tttataagat
23281 ttcaaattac atgaaaagtt cattaacatc ctatttttaa aaacattctt ttggtttatt
23341 ttttagagac aatgtcttgc tgtgttaccc aggctggagt tcagtggctg ttcacaggca
23401 caattgtagc acactgcagc ctcaaactcc aactcacaca atcctcctgc ctccgtttcc
23461 tgagtagctg gaactataga tgcatacctg cataccacca tgtctcaccc ttgcttatcc
23521 cgtttataat ccatccaatt cttttttttt tttttttttt tgagacggag tctcgctctg
23581 tcacccaggc tggagtgcag tggcgtgatc tcggctcact gcaagctccg ccttctgggt
23641 tcatgccatt ctcctgcctc agcctcccga gtagctggga ctacaggcgc ccgccaccgc
23701 gcccagccaa tttttgtat ttttagtaga gacgaggttt caccgtgatc tcgatctcct
23761 gacctcgtga tctgcccgcc ttggcctccc aaagtgctag gattacaggc gtgagccact
23821 gcacctggcc cccaattcat ttttaacaat tattcctaga ttacttataa aaactgagat
23881 attagacata gctagtcatt tcaagttatt ttcctgttaa ccatttttat tacctgtgag
23941 tatcatgtgt tcaattaaga accataaaaa tgaaatatgt aggtattttg ccagtaactc
24001 agaggacaca gctgaagtca ataatacaaa attagttcaa cttacagtta tacaaagatc
24061 attctgtttt taagttgagt ttatagtttt atgaccttaa aaagtctaac agagacaaat
24121 ataaaactga gtagtaaatt caggcaaaaa ttttaaagac acttattttt gatttaccaa
24181 ttattttaaa accagcttat cagatgttta agttatatta actaaaaggc acttgtgtta
24241 attactatat attttgtatt agcactcatt tatttgatga atagaattcc ttaagggatt
24301 tgtggccaac tgccagattt taccacgtag acacaacata caacatatat atacatatgt
24361 gtaaacacac ctaaacatac acatacacaa acatagcttt cattttagaa ttttagtcat
24421 acgatagtaa tacaggcttg ctggtttata aaagacagtt attggattca aattatattt
24481 ctgagaaagt gggacctgct cagctgggta aacatgcaga ataggtaatc ttatgaaagc
24541 tgtgaaccaa aagttttggt aaatagcagt ttggattttt aaaaaacctc ttaccccacc
24601 tccccaaccc cttttttccc ttttttcagt ttcaaatgag tttaatgtta atatttaaat
24661 gcttacattt ttagctagga ctggctgaat tgtataagaa aaaacaatct ccaggtggcc
24721 ttgaattttt agtaacaaat cttttgtttg ccattctggt ttttttgact agtcagtgca
24781 ggcagggaag cattttagca gttgtggatg aggggttttt gttttgttct tttagccttt
24841 gcatagcagg caagcaattt ttatgctata ccagagatac cttatattat tgccctgagc
24901 tcaagatttt gacctgtttg agagcctaat ttttatacgt atttatctag ttcttttagg
24961 ctattaatcc tttaattaac tgttccatca ccctaagcag ttattaggca aacctaaatt
25021 tacattaaaa gggatacttc ttaattctag gtgttggttg ccagggaact attataattt
25081 ataaagccat taatttaagg ccctttaaga cctttttttt tctttttgtt cttggctgga
25141 atgccgtaag gagtgagttt catctcaaca ctggcagaaa cagcagattt aaagtaggca
25201 gaaaaaaaat tagagagctt agaagactct acatatcaac tctatagctg cagtctcttg
25261 gtactaagaa taaaaaagct tggggagttt agacaaagca tagacaatct ctatgatggt
25321 cattgatcca aaaacatgca tgaggaaaag ccacatagct gacctgaagt cccagaaaag
25381 caggcatgcc ttaatgtttg agaatttcca ttttgtttct tctcaatctc ttaagagcaa
25441 agaaaattct gtaaatcctg acagataagt caggtgtttg gaccagtgtt ttaactggtg
25501 gcgattgccc tagtggcttt aaaagagcca tcctgtgccc aaaatttaga atgtttattt
25561 ttgctcttgg gagatgttca gaaacagggg aaaagagcca aatcatttac agatgcatgt
25621 aaccatatcg aaacgaaacc aaaatcagtg ttcccaaaag tgttaaccca gtcatgcaga
25681 ttaaaaaata atataaacac agaagaaccc aaagtaaatt taccagaaaa ggcatgcctc
25741 agaatccaga gtactcagcc aggcgcagtg gcccatgcct gtaatcccag cactttggga
25801 ggccaaggca ggaggatcgc ttgagcccat gagttcaaga ccagcctcag cagtatagtg
25861 agacactgtc tctaaaaaaa aattgttttt aaatccagag tactcaaacc agagggacac
25921 ttgtctttat atcaaaaagg acttgccagg aaagacaaaa agtcttttgt catcccagga
25981 gggatgtaaa gtcctttatt aaagtggtct tagaaccaag acaaatccaa agtcaagtca
26041 aaaagcctct gccaaaagtg ggaggctctg cctgagaaaa gactcactgg ggcagaacag
26101 acaagctatg taagcggaga gcccaaaggg ctcctgtgag tactgcatac tgattctgag
26161 atcaccactt ctctctgaaa tgtgtcctac ttcaggttct actgctgaac accatttatg
26221 tcaacacaga gagaggctct ctaaaagaaa actctatttg ggaatacagc attgctgtag
26281 aaatacgcat gtcatgggcc gtgcgcggtg gcttatgcct gtaatcccag cactttggga
26341 ggctgaggtg ggccgatcac gaggtcagga gtttgagacc agcctggcca acatagtgaa
26401 accccctctc tactaaaaat acaaaaaatt agatgggtgt attggtgggt gcctatgatc
```

TABLE 1-continued 26461 ccgctacttg ggaggctgag gcagaagatt ggcttgaacc tgagaagtgg aggttgcagt
26521 gagcctagat gtgccactgc actccagcct gggcgacagt gcaaaactac gtctccaaaa
26581 aaaaaaaaaa aagacccatg tcatggtaaa ctacgtgtgt attcagggaa gtaaaggaag
26641 acaaagattt taaagaaaaa tgagggttgt ataattgttt tgaaataatt gtcgttggtt
26701 acaaagatca atagcaaggg tggtgccact ctgaagttgg acaggcagtg gctaggcaaa
26761 agtattttgt gggtaacctt tgtgaaaggt tgcagttttt gtaacacaag ctgctttatt
26821 ttcccaaaag ctttcacagt acatagaaaa tatattggac gtgtattaaa tgtgccaaat
26881 tagtcagcaa tattacatta aaatatgtgt tattacttgt taatgttctt aataagttgt
26941 tcaggcagtt ataccagact atcttttctc attttccaat ttataagtgt attatccaaa
27001 aatgttagtt ttagggtgac cactgtatat tttggtattt tttaaagcta cccaattgtg
27061 tataatttat aaaaatcttt ttttcataag acctaaaact tctgaacaat acataggtgc
27121 aaataaataa attccttttt atctcaaact cacttccact gccctccctg aagaaagcct
27181 tttgttattg ttgtcttgac taaatgtggc atgggagcta acattttcaa gggaagctga
27241 tcttatctcc gggctctaga agccaagaca tgaggtatgt gtttaccgtc tcttaggtga
27301 ctctccagaa ctttcattct caacctcctc cctcactgcc agttcctcct cagcttctta
27361 gccaagtggt agaggaaaaa tggtatttta tgtcaggact aagccatgtg ctctgagccc
27421 tgggtaagtc tgcaaggctt ctctagaact catacatagg tcaattattc ctcctctgaa
27481 aacttaaact ctggcaccac tagctttttc ctacagcata catgggctca gtaaatcctc
27541 tgttaagaca acaggaaaat taagacaatg tccttgcaag ccccataact actttctatc
27601 cctgctattc acagccaagt gtgtcgagac cagttcacac aaaccttgtt gattttcggt
27661 ttcacccccct ccttactaaa tcacccctcc atttgctgca gttgcccttg cgtgctgtac
27721 tcagacttgg aggaagtgat gtcttattca aggccagttt ttgtactagt ggttaaataa
27781 atggtttcca aattggagtc agaaggagag cttctaaaat gtaggttccc tggcctcaat
27841 tgtgagattc tgctttagca ggtctggaat tggagcactg ggatctgcat tttcagaaaa
27901 cccaaaatga ttatcagcca ggacttaaac ctctgcttta gaccacattc cctgtgggct
27961 ttcagatttt ctatcaatgt tcttccctct tcccagctcc cacacattaa aactcagatc
28021 atgcagaaaa gaagttacag ttccttcatt tcacatcaat ttctcatgca tcccatctgg
28081 ttttgggaag gtgtgggacg aggtggatgg ccttaaactt gccaatcaaa gataacgttc
28141 tctttcgatt caaatagcct atctcaggct taaaaccatc tctttggata aatgctcagc
28201 ttttcaaagg ttcttcctag cttcttcctc atgatggcat ctagtgggtg agaacagtca
28261 tctccaggtg acacaggaaa gagtttctct aatgtatgtg ctgaggtcct tgacggtcct
28321 gctgctggtg ctcatcctgc catctttgct ggatgtcact gagtctactg ggtaatgtaa
28381 gtgggtccct ggcttttgtt cactgctgtc atgccctgct cctgaccaca actctgtcat
28441 tgcctttggt ctcaaggtct ctaccttaat agcttccatg tcccaactat gggactgtta
28501 atctgctggg ctttggagtg ggtgggaagg gatgatgttg gaactttggg atgtactgaa
28561 catcttgctc aagctttggg aagccaacat tttctcagac tgactagaca cctccttcca
28621 ccaatgctga gctagtgctc ctgtgccata ctgggtaagc ctctaagtca tgagtaggac
28681 ttttttgagt ggcttgcagt cttccccagg ctatgccagg aaagtagttg actaaccctg
28741 ctgctccaag actcgcatac ccatcctgaa gtttccgttt atttcccaac agggcaattg
28801 caatctcaat caatctctcc ctgccctggg agtcattcca ctcctgccta atgaagagac
28861 tcttctcaca tcgtattctc agtttctctt atccatggtt aggagtaaaa ctcatgttca
28921 gttgtccaag ctttgctttt agtatgtgaa tggagctctt agcatgtaga actcccttct
28981 cattctcagt aaagtctgac tttgaagact acttatcatc ttcctagaga tgccaaagaa
29041 taatcaagat aataaaggca ggctctgaga ttcacagctg agtagcaact gtgctgttac
29101 tctagtacac accctctcct ttcctgtgac tgtcaggctt cagggcttac ctttattgga
29161 aagacagcag gggggcatat atgaagaaaa tggaatcttt aatattgtca aagtcttgac
29221 ccaatagaga cattcttgcc ccagactctc ttgcttcagt gcctttgcct gttctggtcc
29281 taagtacctt gaatatcctt ctcttgatgc cctgatataa aactctttat tcctcaaagc
29341 caagttcagg ttatcacctc caccacagac ttttctttcc ctccccaaac ttcattgcct
29401 cttctcatca ctccctttgt aatttgttta tactggtaag agagcattca tcataattag
29461 gcctatctat gcctaccttt cttgttaaat tatgagcttt gttctgcctt ggatatctct
29521 ctggcttgga tatctctctg gcctttgctc tgcacttcca aatgtatcca ttattcaaga
29581 cccaggtttc cagcctgatc aacatagcaa gatcccatct ctccaaaaaa aaaaaaaaaa
29641 aaaaattgtg gggccgggta cagtggctca tgcctgtaat cccagcactt tgggaggccg
29701 aggcaggtgg atcatgaggt cacgagtttg agaccagtct ggccaacata gtgaaacccc
29761 atctgtacta aaaatgcaga aaattagccg ggtgtggtgg tgtgtgcctg taatcccagc
29821 tactcgggag gctgaggcag gagaatcgca tgaacccggg aggcagaggt tgcagtgagc
29881 cgagattgcg ccactgcact ccagcctggg tgacattgca agactccatc tcaaaaaaaa
29941 aaaaaaaaaa aattagctgg gcatggtggc aggcacctgt agtcccagct acttgagagg
30001 ctgaggtggg aggattgctt gagcccagga agtcgaggct tcatgagcca tgtttgtgct
30061 actgcactct agcctggatg acaaagtgag atccttttct aaaaataagg acccagttta
30121 ttttatttag ttatttagtt atttttgaga ccaagtttca tcactcaggc tggagtgcaa
30181 tggcacagtc ttgactcact gcaacctctg cctcctggat tcaagcaatt cttctgcctc
30241 agcctcttga gtagctggga ttgcaggtgc ccgccaccac acctggctaa tttttgtatt
30301 tttggtagag acagggtttc actatgttgg ccaggctggt ctcaaactcc tgacctcagg
30361 tgatccacct gccttggtct cccaaactgc tgggattaca ggtgtgagtc accctgcctg
30421 gccagaaccc agtttaaatt ccatcctctc tgcagagtct tccttaacca cccctattga
30481 aagttacccc tgcttcctac aagaagtggt acttggatgt tcatgagata cctgtgcaag
30541 gctcctgtgg gggtcctggg gagacagtga catggacact catgaaagga accttggaat
30601 agcgagtgtg tgtgctataa aatgtgcttt agatttgatt accaccactt aagttatgag
30661 ctctgatatg gtttgggtct ccatccccac ccaaatctca tcttgaattg taatccctac
30721 atgttgaggg aaggaagtaa ttgtattatg ggggtggttc tcccatgctg ttctcatgat
30781 agtgaattct cacaggatct gatggtttta taaatggtag tttttcctgt actttcacac
30841 actcacactc tcttctgcca ccttgtgaag aaggtgcctg cttccccttc tgccataatt
30901 gtaagtttcc tgaggcctcc ccagctgtat tagtctgatc tcacgcggct aataaagaga
30961 taccggagac tgggtaattt ataaaagagg tttaattgac tcacagtttt acatggctgg
31021 ggaggcctca caattatggc agaaggtgaa gggggagcaa gacacatctt acatggcatc
31081 aggcgagaga gcttgtgtag gggaactccc ctttataaaa ccatcagatc tcgtgagact
31141 tattcactat tacaagagca gcacgggaaa gacccacccc catgattcag ttacctctca
31201 ctgggtccct cacataatat ggggaattat gggagctcca attcaagatg agatttgggt TABLE 1-continued

```
31261 ggggacacag ccaaactata tcaccagcca tgtggaactg ttgagtcaat taaacctctt
31321 tcctttataa attacccagt ctcaggtatt tctttatagc agtgtgagaa cagactaata
31381 caagcacctt gaggtcagag gctaaaatca ctttttccca aacatttcct ttttatatat
31441 gctacatctt tgtgtctgct tcaacatttc cagcagtgct ttatatatgg taggcatgca
31501 ataaatgctt cttgatcgac tgacaggtgc tcagaagatc taggttggtt gattctcttg
31561 tgatgccatc ttttcctgag agctcattaa tttttaagtt gttttccttg aaatgcatgg
31621 tatgtttcct ccaccctgct ctttgccttt catagggttc cattttgatc agctgctctc
31681 attgtctgtt ttgtgatcaa aggttctgat gaactttgga atatgtgtat gtttggagtg
31741 aggatggggt ctggaggaga tgcatggttg aggaccaatt cacccaaccc agcttacaga
31801 agtaaagcgg ccccttagga gcactgaagc attgctgtgg atttcagaat taccttattt
31861 ctttttcttt tttttttttt ttttttgag acgaggtctc gctctgtcgc ccaggctgga
31921 gtgcagtggc acaatctcag ctcactgcaa gctccgcctc ctgggttcac accattctcc
31981 tccctcagcc tccccagcag ctgggactat aggtgcacgc cgccacgcct ggctaatttt
32041 tgtattttta gtggagacag ggtttcaccg tgttagccag gatggtctca atctcctgac
32101 cttgtgatcc acccgcctca gcctcccaaa gtgctgggat tacaggcgtg agccaccgtg
32161 cccagccagc ttctttcaaa tcagagtagg ccttccagtg tggcaggcca taagatctga
32221 agttttcacc ctgttcctgg aagccaagtg gacagcaact aatttttact ttctttattg
32281 cacatttggg gcttgggga tagagtcaga tgtgtgtcag ttgaaactgt agctactgca
32341 ttccactcct tgggggatcg tagtgctcat gccaacagaa aacttcgagg ctaataatta
32401 ctgtcttcag agtacaagac aggcacggaa gttgttttgg cataagaaaa ccacgatttg
32461 catcccacag tctaaggaag acgatgctga attcagaaga tggtgcaaaa gtgtgacagt
32521 tcagctgtgg cggctgttgc tgatgcatgg gactatttta tttacatttc ctttcttctt
32581 ttttaacaga gacaggatct tgctgtgttg cccagcctgg tcttaaactc ctgggcccaa
32641 gtgatcctcc cacctcagcc tcccaacgtg ttgggattac aggcatgagc caccatgcct
32701 gggctttatt tatatttcca agtcaaatgt tagttggtca atcagtcttt ttaagcacca
32761 atttgtgcc tagccttgtg gaaactgtag gaaaaagata ctttttattt gggaggacct
32821 tgatttgctg tcacaggtgc cactaatgcc aattataagg cagtgtggaa tcaggtgatt
32881 gaaagcccag tctgtagcat aaactgctgc agggttccag tgggggcaat taaggtgggc
32941 agggagggtg gatagcattt gactttgaca gcataacctg agcagaggca cagtggggat
33001 ggtgagtgtg cagtgggagg agggagagag gtaagtggta gggaagaggt gggaaggggg
33061 caaggagaag gctcaggagg tttggggaca gggaaatgac ttggttggcg acctcttact
33121 ttcttctcgt gtgtgcaatt tggaattcac ttggttctta gtatttctgg gtcagatgac
33181 ttctttgcag tatgagaaac catttcccag gctggctacc tgggctgtgg tatcttccag
33241 tgctcctctg tgattgtact cagatcagct cgtctaggca ggcaggatgg cagaagccct
33301 ctgacttcat gtctgaaaga gtatgtgttt caactctgta attacagcat ttaacagacg
33361 atatcagccc tctttgggat ggcttttggc aaatgggcta gaagtctatt gtgcatttaa
33421 atgatactgc atcttctctt taaaaggttt ctcagtgagt ccaccccact ctgtatccaa
33481 gtatgtctca ggccatgagg caaaaggaaa tgagtagttc tttttggttg gagaattaaa
33541 aagaaatctc cacccaagta acaggtacat agtgggaaaa aataacatct gcctgaaagc
33601 ttcatcttca ggcaaagaga gggtcagggg gcgggagctt agtaatgggg aaacctcaga
33661 agatttaaag agaattacag acagacaagg ctgaacattg gctgtcatcc aacaaagctc
33721 ttataagatg ggaatcactg cccggttctt gagctccgac ctggagggaa gaggagtctg
33781 gaagacttgg cacaggcctg agtgcttcat tgtctttctg gttccaagtc ctcctcagct
33841 cactaggaag gaggtggggt gggggcaggt aggccactct gcataagtgc acacatctac
33901 actggctagt ctacttcaca attcccccac aggttatcct tatctctacc tggttccagt
33961 tccagattgg agggatatag aataccatcc ccacccctca ccttgcttgc tctggcctgg
34021 aaaactgtca ttcctttacc accagctggc atctgccata tgcttcaagg aactgaataa
34081 agaggaaggg gaaagaagaa actagagaaa ctggaatgct tcctatctga cccccaagta
34141 cagggactgc ctctttccgt aacggcacag aacgtctcca tccctttgac ctccacctcc
34201 ccagagatgc ccgaggagga cagccttgtt tctgtgatct gttgttgaga actgctgctg
34261 agaattcttc cttcagcacc gccttaggca ccattggttt ttcactaggt ccgctgtaga
34321 aaacagccag gaattactta gttgactacc acctgaggtg ctgtttggtg ttggtaataa
34381 agaataaagg tggaaatgaa
```

SEQ ID NO: 2 Human SMAD2 Isoform 1 Amino Acid Sequence
(NP_001003652.1)

```
  1 mssilpftpp vvkrllgwkk saggsggagg geqngqeekw cekavkslvk klkktgrlde
 61 lekaittqnc ntkcvtipst cseiwglstp ntidqwdttg lysfseqtrs ldgrlqvshr
121 kglphviycr lwrwpdlhsh helkaience yafnlkkdev cvnpyhyqrv etpvlppvlv
181 prhteiltel pplddythsi pentnfpagi epqsnyipet pppgyisedg etsdqqlnqs
241 mdtgspaels pttlspvnhs ldlqpvtyse pafwcsiayy elnqrvgetf hasqpsltvd
301 gftdpsnser fclgllsnvn rnatvemtrr higrgvrlyy iggevfaecl sdsaifvqsp
361 ncnqrygwhp atvckippgc nlkifnnqef aallaqsvnq gfeavyqltr mctirmsfvk
421 gwgaeyrrqt vtstpcwiel hlngplqwld kvltqmgsps vrcssms
```

SEQ ID NO: 3 Human SMAD2 transcript variant 3 mRNA Sequence
(NM_001135937.2; CDS: 401-1714)

```
  1 cggccgggag gcggggcggg ccgtaggcaa agggaggtgg ggaggcggtg gccggcgact
 61 ccccgcgccc cgctcgcccc ccggcccttc ccgcggtgct cggcctcgtt cctttcctcc
121 tccgctccct ccgtcttcca tacccgcccc gcgcggcttt cggccggcgt gcctcgcgcc
181 ctaacgggcg gctggaggcg ccaatcagcg ggcggcaggg tgccagcccc ggggctgcgc
241 cggcgaatcg gcggggcccg cggcccaggg tggcaggcgg gtctacccgc gcggccgcgg
301 cggcggagaa gcagctcgcc agccagcagc ccgccagccg ccgggaggtt cgatacaaga
361 ggctgttttc ctagcgtggc ttgctgcctt tggtaagaac atgtcgtcca tcttgccatt
421 cacgccgcca gttgtgaaga gactgctggg atggaagaag tcagctggtg ggtctggagg
481 agcaggcgga ggagagcaga atgggcagga agaaaagtgg tgtgagaaag cagtgaaaag
541 tctggtgaag aagctaaaga aaacaggacg attagatgag cttgagaaag ccatcaccac
601 tcaaaactgt aatactaaat gtgttaccat accaaggtct cttgatggtc gtctccaggt
661 atcccatcga aaaggattgc cacatgttat atattgccga ttatggcgct ggcctgatct
721 tcacagtcat catgaactca aggcaattga aaactgcgaa tatgctttta atcttaaaaa
```

TABLE 1-continued

```
 781 ggatgaagta tgtgtaaacc cttaccacta tcagagagtt gagacaccag ttttgcctcc
 841 agtattagtg ccccgacaca ccgagatcct aacagaactt ccgcctctgg atgactatac
 901 tcactccatt ccagaaaaca ctaacttccc agcaggaatt gagccacaga gtaattatat
 961 tccagaaacg ccacctcctg gatatatcag tgaagatgga gaaacaagtg accaacagtt
1021 gaatcaaagt atggacacag gctctccagc agaactatct cctactactc tttcccctgt
1081 taatcatagc ttggatttac agccagttac ttactcagaa cctgcatttt ggtgttcgat
1141 agcatattat gaattaaatc agagggttgg agaaaccttc catgcatcac agccctcact
1201 cactgtagat ggctttacag acccatcaaa ttcagagagg ttctgcttag gtttactctc
1261 caatgttaac cgaaatgcca cggtagaaat gacaagaagg catataggaa gaggagtgcg
1321 cttatactac ataggtgggg aagtttttgc tgagtgccta agtgatagtg caatctttgt
1381 gcagagcccc aattgtaatc agagatatgg ctggcaccct gcaacagtgt gtaaaattcc
1441 accaggctgt aatctgaaga tcttcaacaa ccaggaattt gctgctcttc tggctcagtc
1501 tgttaatcag ggttttgaag ccgtctatca gctaactaga atgtgcacca taagaatgag
1561 ttttgtgaaa gggtggggag cagaataccg aaggcagacg gtaacaagta ctccttgctg
1621 gattgaactt catctgaatg gacctctaca gtggttggac aaagtattaa ctcagatggg
1681 atccccttca gtgcgttgct caagcatgtc ataaagcttc accaatcaag tcccatgaaa
1741 agacttaatg taacaactct tctgtcatag cattgtgtgt ggtccctatg gactgtttac
1801 tatccaaaag ttcaagagag aaaacagcac ttgaggtctc atcaattaaa gcaccttgtg
1861 gaatctgttt cctatatttg aatattagat gggaaaatta gtgtctagaa atactctccc
1921 attaaagagg aagagaagat tttaaagact taatgatgtc ttattgggca taaaactgag
1981 tgtcccaaag gtttattaat aacagtagta gttatgtgta caggtaatgt atcatgatcc
2041 agtatcacag tattgtgctg tttatataca tttttagttt gcatagatga ggtgtgtgtg
2101 tgcgctgctt cttgatctag gcaaaccttt ataaagttgc agtacctaat ctgttattcc
2161 cacttctctg ttatttttgt gtgtcttttt taatatataa tatatatcaa gattttcaaa
2221 ttatttagaa gcagattttc ctgtagaaaa actaattttt ctgcctttta ccaaaaataa
2281 actcttgggg gaagaaaagt ggattaactt ttgaaatcct tgaccttaat gtgttcagtg
2341 gggcttaaac agtcattctt tttgtggttt tttgtttttt tttgtttttt tttttaactg
2401 ctaaatctta ttataaggaa accatactga aaacctttcc aagcctcttt tttccattcc
2461 catttttgtc ctcataatca aaacagcata acatgacatc atcaccagta atagttgcat
2521 tgatactgct ggcaccagtt aattctggga tacagtaaga attcatatgg agaaagtccc
2581 tttgtcttat gcccaaattt caacaggaat aattggcttg tataatctag cagtctgttg
2641 atttatcctt ccacctcata aaaaatgcat aggtggcagt ataattattt tcagggatat
2701 gctagaatta cttccacata tttatccctt tttaaaaaag ctaatctata aataccgttt
2761 ttccaaaggt attttacaat atttcaacag cagaccttct gctcttcgag tagtttgatt
2821 tggtttagta accagattgc attatgaaat gggccttttg taaatgtaat tgtttctgca
2881 aaatacctag aaaagtgatg ctgaggtagg atcagcagat atgggccatc tgtttttaaa
2941 gtatgttgta ttcagtttat aaattgattg ttattctaca cataattatg aattcagaat
3001 tttaaaaatt gggggaaaag ccatttattt agcaagtttt ttagcttata agttacctgc
3061 agtctgagct gttcttaact gatcctggtt ttgtgattga caatatttca tgctctgtag
3121 tgagaggaga tttccgaaac tctgttgcta gttcattctg cagcaaataa ttattatgtc
3181 tgatgttgac tcattgcagt ttaaacattt cttcttgttt gcatcttagt agaaatggaa
3241 aataaccact cctggtcgtc ttttcataaa ttttcatatt tttgaagctg tctttggtac
3301 ttgttctttg aaatcatatc cacctgtctc tataggtatc attttcaata ctttcaacat
3361 ttggtggttt tctattgggt actccccatt ttcctatatt tgtgtgtata tgtatgtgtt
3421 catgtaaatt tggtatagta atttttttatt cattcaacaa atatttattg ttcacctgtt
3481 tgtaccagga acttttctta gtctttgggt aaaggtgaac aagacaacta cagttcctgc
3541 ctttgctgag acagcagtta cactaaccct taattatctt acttgtctat gaaggagata
3601 aacagggtac tgtactggag aataacagat gggatgcttc aggtaggaca tcaaggaaag
3661 cctctaagga aaggatgcat gagctaacac ctgacattaa agaagcaagc caagtgagga
3721 gccaggggag ataagcattc ctggcaaaga gaatagcatc aaatgcaaaa aggttcacac
3781 taaaggaaac tcctgattag gtattaatgc tttatacaga aacctctata caaatccaaa
3841 cttgaagatc agaatggttc tacagttcat aacattttga aggtggcctt attttgtgat
3901 agtctgcttc atgtgattct cactaacata tctccttcct caacctttgc tgtaaaaatt
3961 tcatttgcac cacatcagta ctacttaatt taacaagctt ttgttgtgta agctctcact
4021 gttttagtgc cctgctgctt gcttccagac tttgtgctgt ccagtaatta tgtcttccac
4081 tacccatctt gtgagcagag taaatgtcct aggtaatacc actatcaggc ctgtaggaga
4141 tactcagtgg agcctctgcc cttctttttc ttacttgaga acttgtaatg gtgttaggga
4201 acagttgtag gggcagaaaa caactctgaa agtggtagaa ggtcctgatc ttggtggtta
4261 ctcttgcatt actgtgttag gtcaagcagt gcctactatg ctgtttcagt agtggagcgc
4321 atctctacag ttctgatgcg atttttctgt acagtatgaa attgggactc aactctttga
4381 aaacacctat tgagcagtta tacctgttga gcagtttact tcctggttgt aattacattt
4441 gtgtgaatgt gtttgatgct ttttaacgag atgatgtttt ttgtatttta tctactgtgg
4501 cctgattttt tttttgtttt ctgcccctcc ccccatttat aggtgtggtt ttcatttttc
4561 taagtgatag aatcccctct ttgttgaatt tttgtcttta tttaaattag caacattact
4621 taggatttat tcttcacaat actgttaatt ttctaggaat gatgacctga gaaccgaatg
4681 gccatgcttt ctatcacatt tctaagatga gtaatatttt ttccagtagg ttccacagag
4741 acaccttggg ggctggctta ggggaggctg ttggagttct cactgactta gtggcatatt
4801 tattctgtac tgaagaactg catggggttt cttttggaaa gagtttcatt gctttaaaaa
4861 gaagctcaga aagtctttat aaccactggt caacgattag aaaaatataa ctggatttag
4921 gcctaccttc tggaataccg ctgattgtgc tctttttatc ctactttaaa gaagctttca
4981 tgattagatt tgagctatat cagttatacc gattatacct tataatacac attcagttag
5041 taaacattta ttgatgcctg ttgtttgccc agccactgtg atggatattg aataataaaa
5101 agatgactag gacggggccc tgacccttga gctgtgcttg gtcttgtaga ggttgtgttt
5161 tttttcctca ggacctgtca ctttggcaga aggaaatctg cctaattttt cttgaaagct
5221 aaattttctt tgtaagtttt tacaaattgt ttaataccta gttgtatttt ttaccttaag
5281 ccacattgag ttttgcttga tttgtctgtc ttttaaacac tgtcaaatgc tttccctttt
5341 gttaaaatta ttttaatttc actttttttg tgcccttgtc aatttaagac taagactttg
5401 aaggtaaaac aaacaaacaa acatcagtct tagtctcttg ctagttgaaa tcaaataaaa
5461 gaaaatatat acccagttgg tttctctacc tcttaaaagc ttcccatata tacctttaag
5521 atccttctct tttttcttta actactaaat aggttcagca tttattcagt gttagatacc
```

TABLE 1-continued 5581 ctcttcgtct gagggtggcg taggtttatg ttgggatata aagtaacaca agacaatctt
5641 cactgtacat aaaatatgtc ttcatgtaca gtctttactt taaaagctga acattccaat
5701 ttgcgccttc cctcccaagc ccctgcccac caagtatctc tttagatatc tagtctgtgg
5761 acatgaacaa tgaatacttt tttcttactc tgatcgaagg cattgatact tagacatatc
5821 aaacatttct tcctttcata tgctttactt tgctaaatct attatattca ttgcctgaat
5881 tttattcttc ctttctacct gacaacacac atccaggtgg tacttgctgg ttatcctctt
5941 tcttgttagc cttgtttttt gttttttttt tttttttttg agagggagtc tcgctctgtt
6001 gcccaacctg gagtgcagtg gtgcgatctt ggttcactgc aagctccgcc tcccgggttc
6061 acgccatgct tctgcctcag cctcccaagt agctgggact acaggcgccc accaccacac
6121 tcggctaatt ttttgtattt ttagtagaga cggggtttca ccgtgttggc caggatggtc
6181 tcgatctcct gacctcgtga tctgtccacc tcggcttccc aaagtgctgg gattacaggc
6241 atgagccacc gcgcccagcc tagccatatt tttatctgca tatatcagaa tgtttctctc
6301 ctttgaactt attaacaaaa aaggaacatg cttttcatac ctagagtcct aatttcttca
6361 tcatgaaggt tgctattcaa attgatcaat cattttaatt ttacaaatgg ctcaaaaatt
6421 ctgttcagta aatgtctttg tgactggcaa atggcataaa ttatgtttaa gattatgaac
6481 ttttctgaca gttgcagcca atgttttccc tacgatacca gatttccatc ttggggcata
6541 ttggattgtt gtatttaaga cagtcagaat aatgatagtg tgtggtctcc agaggtagtc
6601 agaatcctgc tattgagttc tttttatatc ttccttttca attttttatt accattttgt
6661 ttgtttagac tacactttgt agggattgag gggcaaatta tctcttggag tggaattcct
6721 gtgttttgag ccttacaacc aggaaatatg agctatacta gatagcctca tgatagcatt
6781 tacgataaga acttatctcg tgtgttcatg taatttttttg agtaggaact gttttatctt
6841 gaatattgta gctaactata tatagcagaa ctgcctcagt ctttttaaga aggaaataaa
6901 taatatatgt gtatgaattt atatatacat atacactcat agacaaactt aacagttggg
6961 gtcattctaa cagttaaaac aattgttcca ttgtttaaat ctcagatcct ggtaaaatgt
7021 tcttaatttg tctgtgtaca ttttcctttc atggacagac cattggagta cattaatttt
7081 cttaatctgc catttggcag ttcatttaat ataccatttt ttggcaactt ggtaactaag
7141 aatcacagcc aaaatttgtt aacatcaaag aaagctctgc catataccccc gttactaaat
7201 tattatacat ccagcagatt ctgggatgta ctaacttagg gttaactttg ttgttgttga
7261 taatactaga ttgctccctc tttaattctt cttctggtgc aaggttgctg cttaagttac
7321 cctgggaaat actactacaa ggtcaaattt tctagtatct tacagcctga ttgaaggtga
7381 ttcagatctt tgctcaatat aaatggattt tccaagattc tctgggccat ccttgaccca
7441 caggtgatct cgctggagta tattaactta acttcagtgc cagttggttt ggtgccatga
7501 gatccataat gaatccagaa cttcaccatt gcttagatat aagagtccct tggaagaata
7561 atgccactga tgatgggggt cagaaggtgt attaactcaa catagagggc ttttagattt
7621 ttcttcaaaa aaatttcgag aaaagtattc ttttaccctc caaacagtta acagctctta
7681 gtttctccaa atatgctctt tgatttactt atttttaatt aaagatggta atttattgaa
7741 caatgaaatc cgtaatatat tgatttaagg acaaaagtga agttttagaa ttataaaagt
7801 acttaaatat tatatatttt ccatttcata attgttttcc tttctctgtg gctttaaagt
7861 ttttgactat tttacaatgt taatcactag gtaacttgcc atatttctgg ttctatatta
7921 agttctatcc tttataatgc tgttattata aagctggttt ttagcatttg tctgtagcaa
7981 tagaaatttt actaagtctc tgttctccca gtaagttttt tcttttctca gtaagtccct
8041 aagaaaacat ttgtttgcca ctcttactat tcccaatctt ggattgttcg agctgaaaaa
8101 aaatttgatg agaaacagga ggatcctttt ctggtgaata taggttcctg ctttaagaat
8161 gtggaaatcc attgctttat ataactaata tacacacaga ttaattaaaa ttgtgagaaa
8221 taattcacac atgacaagta ggtaacatgc atgagttttg aattttttta aaaacccaac
8281 tgtttgacaa aatatagaac ccaaattggt actttcttag accagtgtaa cctcacacct
8341 cagttttgct tttccaaccc tgacttgaaa ggcatatttg tatcttttta ttagtgatag
8401 tgaagctgtg acactaacct tttatacaaa agagtaaaga aagaaaaact acagcgatta
8461 agatgagaac agttctgcag ttgttgaact agatcacagc attgtaggca gaataaaaaa
8521 tgttcatatc tgagaatatt cctttcgcca tcttttccca aggccagacc tcctggtgga
8581 gcacagttaa aagtaacatt ctgggccttt gtaatcggag ggctgtgtct ccagctggca
8641 gcctttgttt taatatataa tgcaggactg tggaaaacag ttggcataga atattttcac
8701 ctaaaaaaga aagaaaagac atacaaaact ggattaattg caaaaagaga atacagtaaa
8761 ataccatata actggacaaa gctagaagaa cctttagaag atttgtctga aaacagattt
8821 caagagtgag cttttataca ctgctcacta atttgcttga ttactaccaa ctcttcttaa
8881 agttaacacg tttaaggtat ttctggactt cctagccttt tagcaagctt agaggaacta
8941 gccattagct agtgatgtaa aaatattttg gggactgatg cccttaaagg ttatgccctt
9001 gaaagttctt accttttctc tagtgatatt aaggaacgag tgggtagtgt tctcagggtg
9061 accagctgcc ctaaagtgcc tgggattgag ggtttccctg gatgcgggac tttccctgga
9121 tacaaaactt ttagcagagt tttgtatata tgtggatttt tctgataagt agcacatcag
9181 aggccttaac cactgcccaa aagcgattct ccattgagag tacatatctt gaacttaaga
9241 aattcatttg ctctgatttt taatcttgta aagtttttgc taaactcaaa acaagtccca
9301 ggcacaccag aaggagctga ccaccttagg tgttcttgtg atttatcctt acttccctat
9361 gttgtcatag ttgcttctaa actcagctgc actatggctg tcaacatttc tgatacttat
9421 tgggatatgt gccatccagt catttagtac tttgaatgga acatgagatt tataacacag
9481 gtaatagctg aaggtaccag tatggtggtg agactcacac ttagtgatcc agctaaggta
9541 actgatgtta taatggaaca gagaagaggc caactagata gctaagttct tctgaaccta
9601 tgtgtatatg taagtacaaa tcatgcgtcc ttatggggtt aaacttaatc tgaaatttac
9661 atttttcata gtaaaaggaa accaattgtt gcagatttct tttcttgtga ggaaatacat
9721 ggcctttgat gctctggcgt ctactgcatt tcccagtctg ttctgctcga gaagccagaa
9781 tgtgttgtta acatttttcc gtgaatgttg tgttaaaatg attaaatgca tcagccaatg
9841 gcaagtgaag gaattgggtg tcctgatgca gactgagcag tttctctcaa ttgtagcctc
9901 atactcataa ggtgcttacc agctagaaca ttgagcacgt gaggtgagat tttttttctc
9961 tgatggcatt aactttgtaa tgcaatatga tggatgcaga ccctgttctt gtttccctct
10021 ggaagtcctt agtggctgca tccttggtgc actgtgatgg agatattaaa tgtgttcttt
10081 gtgagctttc gttctatgat tgtcaaaagt acgatgtggt tccttttttta tttttattaa
10141 acaatgagct gaggctttat tacagctggt tttcaagtta aaattgttga atactgatgt
10201 ctttctccca cctacaccaa atattttagt ctatttaaag tacaaaaaaa gttctgctta
10261 agaaaacatt gcttacatgt cctgtgattt ctggtcaatt tttatatata tttgtgtgca
10321 tcatctgtat gtgctttcac tttttacctt gtttgctctt acctgtgtta acagccctgt TABLE 1-continued 10381 caccgttgaa aggtggacag ttttcctagc attaaaagaa agccatttga gttgtttacc
10441 atgttaaaaa aaaaaaaaaa a SEQ ID NO: 4 Human SMARD2 Isoform 2 Amino Acid Sequence
NP_001129409.1)
1 mssilpftpp vvkrllgwkk saggsggagg geqngqeekw cekavkslvk klkktgrlde
61 lekaittqnc ntkcvtiprs ldgrlqvshr kglphviycr lwrwpdlhsh helkaience
121 yafnlkkdev cvnpyhyqrv etpvlppvlv prhteiltel ppldhythsi pentnfpagi
181 epqsnyipet pppgyisedg etsdqqlnqs mdtgspaels pttlspvnhs ldlqpvtyse
241 pafwcsiayy elnqrvgetf hasqpsltvd gftdpsnser fclgllsnvn rnatvemtrr
301 higrgvrlyy iggevfaecl sdsaifvqsp ncnqrygwhp atvckippgc nlkifnnqef
361 aallaqsvnq gfeavyqltr mctirmsfvk gwgaeyrrqt vtstpcwiel hlngplqwld
421 kvltqmgsps vrcssms SEQ ID NO: 5 Human SMARD2 transcript variant 1 mRNA Sequence
(NM_005901.6; CDS: 353-1756)
1 gcgcgcgtcc tcacccctc cttccccgcg ggcggcggcc aggctccctc ccctcccctt
61 ccctctcctc ccctcccctc ccctctcttc ccctaccctc ccgcgcgccc gggccgccgg
121 ccgggcccgg gcctgggggc ggggcgggaa gacggcggcc gggagtgttt tcagttccgc
181 ctccaatcgc ccattcccct cttcccctcc cagccccctc catcccatcg gaagaggaag
241 gaacaaaagg tcccggaccc cccggatctg acggggcggg acctggcgcc accttgcagg
301 ttcgatacaa gaggctgttt tcctagcgtg gcttgctgcc tttggtaaga acatgtcgtc
361 catcttgcca ttcacgccgc cagttgtgaa gagactgctg ggatggaaga agtcagctgg
421 tgggtctgga ggagcaggcg gaggagagca gaatgggcag gaagaaaagt ggtgtgagaa
481 agcagtgaaa agtctggtga agaagctaaa gaaaacagga cgattagatg agcttgagaa
541 agccatcacc actcaaaact gtaatactaa atgtgttacc ataccaagca cttgctctga
601 aatttgggga ctgagtacac caaatacgat agatcagtgg gatacaacag gcctttacag
661 cttctctgaa caaaccaggt ctcttgatgg tcgtctccag gtatcccatc gaaaaggatt
721 gccacatgtt atatattgcc gattatggcg ctggcctgat cttcacagtc atcatgaact
781 caaggcaatt gaaaactgcg aatatgcttt taatcttaaa aaggatgaag tatgtgtaaa
841 cccttaccac tatcagagag ttgagacacc agttttgcct ccagtattag tgccccgaca
901 caccgagatc ctaacagaac ttccgcctct ggatgactat actcactcca ttccagaaaa
961 cactaacttc ccagcaggaa ttgagccaca gagtaattat attccagaaa cgccacctcc
1021 tggatatatc agtgaagatg gagaaacaag tgaccaacag ttgaatcaaa gtatggacac
1081 aggctctcca gcagaactat ctcctactac tctttcccct gttaatcata gcttggattt
1141 acagccagtt acttactcag aacctgcatt ttggtgttcg atagcatatt atgaattaaa
1201 tcagagggtt ggagaaacct tccatgcatc acagccctca ctcactgtag atggctttac
1261 agacccatca aattcagaga ggttctgctt aggtttactc tccaatgtta accgaaatgc
1321 cacggtagaa atgacaagaa ggcatatagg aagaggagtg cgcttatact acataggtgg
1381 ggaagttttt gctgagtgcc taagtgatag tgcaatcttt gtgcagagcc ccaattgtaa
1441 tcagagatat ggctggcacc ctgcaacagt gtgtaaaatt ccaccaggct gtaatctgaa
1501 gatcttcaac aaccaggaat ttgctgctct tctggctcag tctgttaatc agggttttga
1561 agccgtctat cagctaacta gaatgtgcac cataagaatg agttttgtga aagggtgggg
1621 agcagaatac cgaaggcaga cggtaacaag tactccttgc tggattgaac ttcatctgaa
1681 tggacctcta cagtggttgg acaaagtatt aactcagatg ggatccccttt cagtgcgttg
1741 ctcaagcatg tcataaagct tcaccaatca agtcccatga aaagacttaa tgtaacaact
1801 cttctgtcat agcattgtgt gtggtcccta tggactgttt actatccaaa agttcaagag
1861 agaaaacagc acttgaggtc tcatcaatta aagcaccttg tggaatctgt ttcctatatt
1921 tgaatattag atgggaaaat tagtgtctag aaatactctc ccattaaaga ggaagagaag
1981 attttaaaga cttaatgatg tcttattggg cataaaactg agtgtcccaa aggtttatta
2041 ataacagtag tagttatgtg tacaggtaat gtatcatgat ccagtatcac agtattgtgc
2101 tgtttatata catttttagt ttgcatagat gaggtgtgtg tgtgcgctgc ttcttgatct
2161 aggcaaacct ttataaagtt gcagtaccta atctgttatt cccacttctc tgttattttt
2221 gtgtgtcttt tttaatatat aatatatatc aagattttca aattatttag aagcagattt
2281 tcctgtagaa aaactaattt ttctgccttt taccaaaaat aaactcttgg gggaagaaaa
2341 gtggattaac ttttgaaatc cttgacctta atgtgttcag tggggcttaa acagtcattc
2401 tttttgtggt tttttgtttt tttttgtttt ttttttttaac tgctaaatct tattataagg
2461 aaaccatact gaaaaccttt ccaagcctct tttttccatt cccattttg tcctcataat
2521 caaaacagca taacatgaca tcatcaccag taatagttgc attgatactg ctggcaccag
2581 ttaattctgg gatacagtaa gaattcatat ggagaaagtc cctttgtctt atgcccaaat
2641 ttcaacagga ataattggct tgtataatct agcagtctgt tgatttatcc ttccacctca
2701 taaaaaaatgc ataggtggca gtataattat tttcagggat atgctagaat tacttccaca
2761 tatttatccc tttttaaaaa agctaatcta taaataccgt ttttccaaag gtattttaca
2821 atatttcaac agcagacctt ctgctcttcg agtagtttga tttggtttag taaccagatt
2881 gcattatgaa atgggccttt tgtaaatgta attgtttctg caaaatacct agaaaagtga
2941 tgctgaggta ggatcagcag atatgggcca tctgtttttta aagtatgttg tattcagttt
3001 ataaattgat tgttattcta cacataatta tgaattcaga attttaaaaa ttgggggaaa
3061 agccatttat ttagcaagtt ttttagctta taagttacct gcagtctgag ctgttcttaa
3121 ctgatcctgg ttttgtgatt gacaatattt catgctctgt agtgagagga gatttccgaa
3181 actctgttgc tagttcattc tgcagcaaat aattattatg tctgatgttg actcattgca
3241 gtttaaacat ttcttcttgt ttgcatctta gtagaaatgg aaaataacca ctcctggtcg
3301 tcttttcata aattttcata tttttgaagc tgtctttggt acttgttctt tgaaatcata
3361 tccacctgtc tctataggta tcattttcaa tactttcaac atttggtggt tttctattgg
3421 gtactcccca ttttcctata tttgtgtgta tatgtatgtg ttcatgtaaa tttggtatag
3481 taatttttta ttcattcaac aaatatttat tgttcacctg tttgtaccag gaacttttct
3541 tagtctttgg gtaaaggtga acaagacaac tacagttcct gcctttgctg agacagcagt
3601 tacactaacc cttaattatc ttacttgtct atgaaggaga taaacagggt actgtactgg
3661 agaataacag atgggatgct tcaggtagga catcaaggaa agcctctaag gaaaggatgc
3721 atgagctaac acctgacatt aaagaagcaa gccaagtgag gagccagggg agataagcat
3781 tcctggcaaa gagaatagca tcaaatgcaa aaaggttcac actaaaggaa actcctgatt TABLE 1-continued

| | | | | | | |
|---|---|---|---|---|---|---|
| 3841 | aggtattaat | gctttataca | gaaacctcta | tacaaatcca | aacttgaaga | tcagaatggt |
| 3901 | tctacagttc | ataacatttt | gaaggtggcc | ttattttgtg | atagtctgct | tcatgtgatt |
| 3961 | ctcactaaca | tatctccttc | ctcaaccttt | gctgtaaaaa | tttcatttgc | accacatcag |
| 4021 | tactacttaa | tttaacaagc | ttttgttgtg | taagctctca | ctgttttagt | gccctgctgc |
| 4081 | ttgcttccag | actttgtgct | gtccagtaat | tatgtcttcc | actacccatc | ttgtgagcag |
| 4141 | agtaaatgtc | ctaggtaata | ccactatcag | gcctgtagga | gatactcagt | ggagcctctg |
| 4201 | cccttctttt | tcttacttga | gaacttgtaa | tggtgttagg | gaacagttgt | aggggcagaa |
| 4261 | aacaactctg | aaagtggtag | aaggtcctga | tcttggtggt | tactcttgca | ttactgtgtt |
| 4321 | aggtcaagca | gtgcctacta | tgctgtttca | gtagtggagc | gcatctctac | agttctgatg |
| 4381 | cgatttttct | gtacagtatg | aaattgggac | tcaactcttt | gaaaacacct | attgagcagt |
| 4441 | tatacctgtt | gagcagttta | cttcctggtt | gtaattacat | ttgtgtgaat | gtgtttgatg |
| 4501 | ctttttaacg | agatgatgtt | ttttgtattt | tatctactgt | ggcctgattt | ttttttgtt |
| 4561 | ttctgcccct | ccccccattt | ataggtgtgg | ttttcatttt | tctaagtgat | agaatcccct |
| 4621 | ctttgttgaa | tttttgtctt | tatttaaatt | agcaacatta | cttaggattt | attcttcaca |
| 4681 | atactgttaa | ttttctagga | atgatgacct | gagaaccgaa | tggccatgct | ttctatcaca |
| 4741 | tttctaagat | gagtaatatt | ttttccagta | ggttccacag | agacaccttg | gggggctggct |
| 4801 | taggggaggc | tgttggagtt | ctcactgact | tagtggcata | tttattctgt | actgaagaac |
| 4861 | tgcatggggt | ttctttttgga | aagagtttca | ttgctttaaa | aagaagctca | gaaagtcttt |
| 4921 | ataaccactg | gtcaacgatt | agaaaaatat | aactggattt | aggcctacct | tctggaatac |
| 4981 | cgctgattgt | gctcttttta | tcctacttta | aagaagcttt | catgattaga | tttgagctat |
| 5041 | atcagttata | ccgattatac | cttataatac | acattcagtt | agtaaacatt | tattgatgcc |
| 5101 | tgttgtttgc | ccagccactg | tgatggatat | tgaataataa | aaagatgact | aggacggggc |
| 5161 | cctgaccctt | gagctgtgct | tggtcttgta | gaggttgtgt | tttttttcct | caggacctgt |
| 5221 | cactttggca | gaaggaaatc | tgcctaattt | ttcttgaaag | ctaaattttc | tttgtaagtt |
| 5281 | tttacaaatt | gtttaatacc | tagttgtatt | ttttacctta | agccacattg | agttttgctt |
| 5341 | gatttgtctg | tcttttaaac | actgtcaaat | gctttccctt | ttgttaaaat | tattttaatt |
| 5401 | tcactttttt | tgtgcccttg | tcaatttaag | actaagactt | tgaaggtaaa | acaaacaaac |
| 5461 | aaacatcagt | cttagtctct | tgctagttga | aatcaaataa | aagaaaatat | atacccagtt |
| 5521 | ggtttctcta | cctcttaaaa | gcttcccata | tataccttta | agatccttct | ctttttttctt |
| 5581 | taactactaa | ataggttcag | catttattca | gtgttagata | ccctcttcgt | ctgagggtgg |
| 5641 | cgtaggttta | tgttgggata | taaagtaaca | caagacaatc | ttcactgtac | ataaaatatg |
| 5701 | tcttcatgta | cagtctttac | tttaaaagct | gaacattcca | atttgcgcct | tccctcccaa |
| 5761 | gcccctgccc | accaagtatc | tctttagata | tctagtctgt | ggacatgaac | aatgaatact |
| 5821 | tttttcttac | tctgatcgaa | ggcattgata | cttagacata | tcaaacattt | cttcctttca |
| 5881 | tatgctttac | tttgctaaat | ctattatatt | cattgcctga | attttattct | tcctttctac |
| 5941 | ctgacaacac | acatccaggt | ggtacttgct | ggttatcctc | tttcttgtta | gccttgtttt |
| 6001 | ttgttttttt | ttttttttt | tgagagggag | tctcgctctg | ttgcccaacc | tggagtgcag |
| 6061 | tggtgcgatc | ttggttcact | gcaagctccg | cctcccgggt | tcacgccatg | cttctgcctc |
| 6121 | agcctcccaa | gtagctggga | ctacaggcgc | ccaccaccac | actcggctaa | tttttttgtat |
| 6181 | ttttagtaga | gacggggttt | caccgtgttg | gccaggatgg | tctcgatctc | ctgacctcgt |
| 6241 | gatctgtcca | cctcggcttc | ccaaagtgct | gggattacag | gcatgagcca | ccgcgcccag |
| 6301 | cctagccata | tttttatctg | catatatcag | aatgtttctc | tcctttgaac | ttattaacaa |
| 6361 | aaaaggaaca | tgcttttcat | acctagagtc | ctaatttctt | catcatgaag | gttgctattc |
| 6421 | aaattgatca | atcattttaa | ttttacaaat | ggctcaaaaa | ttctgttcag | taaatgtctt |
| 6481 | tgtgactggc | aaatggcata | aattatgttt | aagattatga | acttttctga | cagttgcagc |
| 6541 | caatgttttc | cctacgatac | cagatttcca | tcttggggca | tattggattg | ttgtatttaa |
| 6601 | gacagtcaga | ataatgatag | tgtgtggtct | ccagaggtag | tcagaatcct | gctattgagt |
| 6661 | tctttttata | tcttcctttt | caattttttta | ttaccatttt | gtttgtttag | actacacttt |
| 6721 | gtagggattg | aggggcaaat | tatctcttgg | agtggaattc | ctgtgttttg | agccttacaa |
| 6781 | ccaggaaata | tgagctatac | tagatagcct | catgatagca | tttacgataa | gaacttatct |
| 6841 | cgtgtgttca | tgtaattttt | tgagtaggaa | ctgttttatc | ttgaatattg | tagctaacta |
| 6901 | tatatagcag | aactgcctca | gtctttttaa | gaaggaaata | aataatatat | gtgtatgaat |
| 6961 | ttatatatac | atatacactc | atagacaaac | ttaacagttg | gggtcattct | aacagttaaa |
| 7021 | acaattgttc | cattgtttaa | atctcagatc | ctggtaaaat | gttcttaatt | tgtctgtgta |
| 7081 | catttccttt | tcatggacag | accattggag | tacattaatt | ttcttaatct | gccatttggc |
| 7141 | agttcattta | atataccatt | ttttggcaac | ttggtaacta | agaatcacag | ccaaaatttg |
| 7201 | ttaacatcaa | agaaagctct | gccatatacc | ccgttactaa | attattatac | atccagcaga |
| 7261 | ttctgggatg | tactaactta | gggttaactt | tgttgttgtt | gataatacta | gattgctccc |
| 7321 | tctttaattc | tcttctggt | gcaaggttgc | tgcttaagtt | accctgggaa | atactactac |
| 7381 | aaggtcaaat | tttctagtat | cttacagcct | gattgaaggt | gattcagatc | tttgctcaat |
| 7441 | ataaatggat | tttccaagat | tctctgggcc | atccttgacc | cacaggtgat | ctcgctggag |
| 7501 | tatattaact | taacttcagt | gccagttggt | ttggtgccat | gagatccata | atgaatccag |
| 7561 | aacttcacca | ttgcttagat | ataagagtcc | cttggaagaa | taatgccact | gatgatgggg |
| 7621 | gtcagaaggt | gtattaactc | aacatagagg | gcttttagat | ttttcttcaa | aaaaatttcg |
| 7681 | agaaaagtat | tcttttaccc | tccaaacagt | taacagctct | tagtttctcc | aaatatgctc |
| 7741 | tttgatttac | ttatttttaa | ttaaagatgg | taatttattg | aacaatgaaa | tccgtaatat |
| 7801 | attgatttaa | ggacaaaagt | gaagttttag | aattataaaa | gtacttaaat | attatatatt |
| 7861 | ttccatttca | taattgtttt | cctttctctg | tggctttaaa | gtttttgact | attttacaat |
| 7921 | gttaatcact | aggtaacttg | ccatatttct | ggttctatat | taagttctat | cctttataat |
| 7981 | gctgttatta | taaagctggt | ttttagcatt | tgtctgtagc | aatagaaatt | ttactaagtc |
| 8041 | tctgttctcc | cagtaagttt | tttcttttct | cagtaagtcc | ctaagaaaac | atttgtttgc |
| 8101 | cactcttact | attcccaatc | ttggattgtt | cgagctgaaa | aaaaatttga | tgagaaacag |
| 8161 | gaggatcctt | ttctggtgaa | tataggttcc | tgctttaaga | atgtggaaat | ccattgcttt |
| 8221 | atataactaa | tatacacaca | gattaattaa | aattgtgaga | aataattcac | acatgacaag |
| 8281 | taggtaacat | gcatgagttt | tgaatttttt | taaaaaccca | actgtttgac | aaaatataga |
| 8341 | acccaaattg | gtactttctt | agaccagtgt | aacctcacac | ctcagttttg | cttttccaac |
| 8401 | cctgacttga | aaggcatatt | tgtatctttt | tattagtgat | agtgaagctg | tgacactaac |
| 8461 | cttttataca | aaagagtaaa | gaaagaaaaa | ctacagcgat | taagatgaga | acagttctgc |
| 8521 | agttgttgaa | ctagatcaca | gcattgtagg | cagaataaaa | aatgttcata | tctgagaata |
| 8581 | ttcctttcgc | catcttttcc | caaggccaga | cctcctggtg | gagcacagtt | aaaagtaaca |

TABLE 1-continued

```
 8641 ttctgggcct ttgtaatcgg agggctgtgt ctccagctgg cagcctttgt tttaatatat
 8701 aatgcaggac tgtggaaaac agttggcata gaatattttc acctaaaaaa gaaagaaaag
 8761 acatacaaaa ctggattaat tgcaaaaaga gaatacagta aaataccata taactggaca
 8821 aagctagaag aacctttaga agatttgtct gaaaacagat ttcaagagtg agcttttata
 8881 cactgctcac taatttgctt gattactacc aactcttctt aaagttaaca cgtttaaggt
 8941 atttctggac ttcctagcct tttagcaagc ttagaggaac tagccattag ctagtgatgt
 9001 aaaaatattt tggggactga tgcccttaaa ggttatgccc ttgaaagttc ttaccttttc
 9061 tctagtgata ttaaggaacg agtgggtagt gttctcaggg tgaccagctg ccctaaagtg
 9121 cctgggattg agggtttccc tggatgcggg actttccctg gatacaaaac ttttagcaga
 9181 gttttgtata tatgtggatt tttctgataa gtagcacatc agaggcctta accactgccc
 9241 aaaagcgatt ctccattgag agtacatatc ttgaacttaa gaaattcatt tgctctgatt
 9301 tttaatcttg taaagttttt gctaaactca aaacaagtcc caggcacacc agaaggagct
 9361 gaccacctta ggtgttcttg tgatttatcc ttacttccct atgttgtcat agttgcttct
 9421 aaactcagct gcactatggc tgtcaacatt tctgatactt attgggatat gtgccatcca
 9481 gtcatttagt actttgaatg gaacatgaga tttataacac aggtaatagc tgaaggtacc
 9541 agtatggtgg tgagactcac acttagtgat ccagctaagg taactgatgt tataatggaa
 9601 cagagaagag gccaactaga tagctaagtt cttctgaacc tatgtgtata tgtaagtaca
 9661 aatcatgcgt ccttatgggg ttaaacttaa tctgaaattt acatttttca tagtaaaagg
 9721 aaaccaattg ttgcagattt cttttcttgt gaggaaatac atggcctttg atgctctggc
 9781 gtctactgca tttcccagtc tgttctgctc gagaagccag aatgtgttgt taacattttt
 9841 ccgtgaatgt tgtgttaaaa tgattaaatg catcagccaa tggcaagtga aggaattggg
 9901 tgtcctgatg cagactgagc agtttctctc aattgtagcc tcatactcat aaggtgctta
 9961 ccagctagaa cattgagcac gtgaggtgag atttttttc tctgatggca ttaactttgt
10021 aatgcaatat gatggatgca gaccctgttc ttgtttccct ctggaagtcc ttagtggctg
10081 catccttggt gcactgtgat ggagatatta aatgtgttct ttgtgagctt tcgttctatg
10141 attgtcaaaa gtacgatgtg gttccttttt tatttttatt aaacaatgag ctgaggcttt
10201 attacagctg gttttcaagt taaaattgtt gaatactgat gtctttctcc cacctacacc
10261 aaatatttta gtctatttaa agtacaaaaa aagttctgct taagaaaaca ttgcttacat
10321 gtcctgtgat ttctggtcaa tttttatata tatttgtgtg catcatctgt atgtgctttc
10381 actttttacc ttgtttgctc ttacctgtgt taacagccct gtcaccgttg aaaggtggac
10441 agtttcccta gcattaaaag aaagccattt gagttgttta ccatgttact atgggactaa
10501 tttttaattg ttttaatttt tatttaaact gatctttttt tatatgggat tacattttgg
10561 tgttcactcc ctaaattata tggaaaccaa aaaaagtgat tgtatttcac atatggacat
10621 atgattttaa gagtacatgt ttttgttttt ttaatttggt gttacataaa agattatcct
10681 atccccccgg gagataaatt tatactactt aatataaccc cacaacaggc gcacaccaca
10741 cactgcacag tgctatttat acatttttat ttatttcaga gtttgcctat gctacattag
10801 cgctctaata cataagatct atgctgtaaa caaaaacatc ttcaaagttg aaatttgctg
10861 aaatatactt ttaacaaaat aacattttta aggctccatt gaaaaatact agataagata
10921 taatctcata taatcagtat gaataatttt aaaaatgaga aatatttagg tcagccacac
10981 ttcctttgtg ccttgcaaga attcagttct gtggatgaat cagtactggt tagcagactg
11041 ttttctgcaa accattttaa acatgcttta gtatgcaaca aaaagggacc tcaaatgcta
11101 aaatacacta ttttacgtgg cattgaatag ccttgggact ggtgtagttt tatcaacact
11161 tttttattag gaagaaaccc aagaaaattt actgtaattg ctaccacctg ccactgtata
11221 aataatctaa aagggacttc ccaacattga acaacaacat tgagggctga ctcgagatcc
11281 ttctacattg tcacctcagc ctggctttgc ctgtcactgc ttagcttgaa gtagtgacac
11341 tgttctgtat caggagattt ttataatggc cctagcatcc ataattccac atgttcatca
11401 aatggctgaa gagtatgaga gaagtattaa ggtctatgtt tgggctgtct ccccacttgg
11461 catattctgt ttttccctct tcaaaataga ttgaaagcct cttagtgcag gaagcaggca
11521 tcagtatcaa actgatgtca tccaatgtaa ttattttaag ctccaggttt gtctaagttt
11581 gggtgaagaa tgttcaggaa catgtttgca acatacagtt atccagctta ccctttgaca
11641 gattcaccct tctcatcaaa atagtaagcc caacctaaaa attataagtt tacaaataaa
11701 ggaatagaaa aacccaaaaa gctaatttac acataaaaat tatcttttgc tgcaataaat
11761 aggtatggaa atatttgtag aattggttta actgatttg taaaacaaat gtcatgctat
11821 tttgccatag tgagacatgc agtaattctt aaaatcacat taatagaagg caagaacatt
11881 gaatcagact tagcagataa cagattcagt gataaatgaa caatagacta agcatactta
11941 ggaagctaca tgagaacaga atgtattact gtgctcccgt ccaaactgca tgactttatt
12001 ggttatagaa taaatggaat ttgagatggg gatttgccag tttttacagt ctgtcttcaa
12061 tagttttgtt ggctgcctct gcacctttct aaatgttatg tgaaaataaa attatttaag
12121 ttctaaagta gtttaggaaa gagatgtgat gacaggaaaa agaagttaac ttctgaacag
12181 tttggtccag gaagaagatg ggcagaatac agtaagccca gggttgaaga atacattcaa
12241 tttggagaga tggagaagac ctttgaagaa ggtcaaaatg agatcttgga acagaactct
12301 cacctgtgtg tctggatata catgaaaact ggacggtgtt attgagctac tgcttatatg
12361 gtgagcagaa aattgataac cacaagcctg gtaggttctg ctatgaagcc cacatataat
12421 cacaaggcct agatagcttg gagttaaaag ccaaggatag ctgtatagtt tgggttccat
12481 agtttgcagt gagattgtgc ttctgagcag tcatttgggg gcagtggttc tgagattaca
12541 agccataacc cagccaagaa cgggctacct gtggaatgag gatgaggaag ttgctacata
12601 taaaccctag tgtgtgtgtg tgtattaagt gaaacttagt taactttttt gctcacagcc
12661 aaagatgatt catctagaga agccattgga attttagcag agttttgtat atatgtggat
12721 ttttctaata agtagcaaat cagaggcctt aaccactgcc caacagcgat tctccattga
12781 gagtacgtat cttgaactta agaaattcat ttgctctgat tttaaatctt gtaaagtttt
12841 tcttcatgag aggtcttgcc tctaaactat attgtggcag tatttgatca aactacataa
12901 gtaccatgta aataagattt taatacaaat gatgactcac ttctaaatgg tttgccattt
12961 agaaatgtgc tgctgtgaga aaaacgaatt tttttttttt ttttttggag acagagtctt
13021 gctctgttgc ccaggctggg gtgcagtggg gcgatctcgg ctcactgcag cctcgcctcc
13081 tgggttcaag tgattctcct gccttagcct cctgagtagc tgggattaca ggcacacacc
13141 accacgccca actacttttt gtatttttag tggagacagg gtttcaccat gtttgccagg
13201 ctggtcttga actcctgacc tcagatgatt tgcctgcctc ggcctcccaa agtgctggaa
13261 ttacaggcgt gagccatcat gcctggctga aaagtgaaaa tttaagccag cttaccacct
13321 ggaataaaaa tgttttatag gaatgtctag gttgctcttt tatattgaaa aaaaacttat
13381 tagtgtctgt tttacccaag aaccacaagc tacttcattt caacttttaa atcatgaata
```

TABLE 1-continued 13441 ataacgtgtt atcaccacat ttaaaaatgt acatcgtcaa tcacaaacac atattctaag
13501 gaattgaatt ttatagagat aattgaatgc tttcatctgt aaaagaatta gtggcctgca
13561 aaccactgtg gattcttgct atgctttgaa gttgtcagtg ggggaatttg ctgctgcaag
13621 ttacttagac ttgtaggcaa agggaaattc aaatttttaa ttctaaaatg aaaaccactg
13681 acaaaatttt atactctgaa agtttggttg ttagcttagt cattattttc ctgttcttta
13741 tcatttcgga attcagatgc ttaaatttaa catacaaatt atttgttggt aaaacataaa
13801 acataaaaag ctacatttgg taaactaaat tttaggattc aaagtctcta acaatttcta
13861 tgtgacatgt catacggtgc agtttttatt tgccaaagtg tctacttcat actgcctatg
13921 cactgcttcc cgtttttaat ctctctaccc caacccccct ataattaaat aaacccctag
13981 aaaactgcct tcttttagaa tacctaattg attactttaa atatttttc agaatcaaaa
14041 ttacaaaagg gagagatacc taagaatctg gcttgtttat attctttaaa agatcgcatt
14101 tgattgaagg tgggtgcata tttttatat ccactctttc cccatttgta tgtgaccatt
14161 gtaaaagtgg atgtgctttt tttttttgc tgaggtctag agacaatgtt ttagagatac
14221 agaatgaaac atttatgggt aaaatacaat gggtaagact tgcttcaaaa tagtatgtga
14281 cagaggaagt agatggaggt atgaatgaat aggacattga tggttgtttg ttgggattgg
14341 gtaagggagc tttgttgtat tctatttcct tttagataag tttgaaattc cttgtagtga
14401 agaaattaaa cgtctccatc aggtgcattg ccacgtcttc tctaggaagc ctccttaaca
14461 tcctctggtg gctcctgaac tttttctgtt ctcattcaca gggaagctca tggggctgcc
14521 tggagacttg aggttacatc ttgcctagta ttaccaaaat tgtgatactt ttctccaccc
14581 cataatagca cagtctttgg tctcaacttg aactaaagtc tttttttttt tttttttttt
14641 tttttttagt atttattgat cattcttggg tgtttctcgg agagggggat gtggcagggt
14701 cataggacaa tagtggaggg aaggtcagca gataaacatg tgaacaaggg tctctggttt
14761 tcctaggcag aggaccctgc ggccttctgc agtgtttgtg tccctgggta cttgagatta
14821 aggagtggtg atgactctta acgagcatgc tgccttcaag catctgttta acaaagcaca
14881 tcttgcaccg cccttaatcc atttaaccct gagtggacac agcacatgtt tcagagagca
14941 cggggttggg ggtaaggtta tagattaaca gcatcccaag gcagaagaat ttttcctagt
15001 acagaacaaa atggagtctc ctatgtctac ttctttctac acagacacag caacaatctg
15061 atctctcttt cctttcccca catttccccc ttttctattc gacaaaaccg ccatcgtcat
15121 catggcccgc tctcaatgag ctgttgggta cacctcccag acagggtggc ggccgggcag
15181 aggggctcct cacttcccag acggggcggc tgggcagagg cgcccccccca cctcccggac
15241 ggggtggatg ctggccgggg gctgcccccc acctcccgaa cggggcagct ggccgggcgg
15301 gggttgcccc ccacctcccg gacggggcgg ctggccgagc aggggctgcc ccccacctcc
15361 ctcccagacg gggcggctgc tgggcggaga cgctccttac ttcccggacg gggtggttgc
15421 tgggcggagg ggctcctcac ttctcagacg gggcggccgg gcagagacgc tcctcacctc
15481 ccagacgggg tggcggtcgg gcagagacac tcctcacatc ccagacgggg cggcggggca
15541 gaggcgctcc ccacatctca gacgatgggc ggccgggaag aggcgctcct cacttcccag
15601 actgggcggc cgggctgagg ggctcctcac atcccagacg atgggcagcc aggcagagat
15661 gctcctcact tcccagacgg ggtggcggcc gggcagaggc tgcaatctcc gcactttggg
15721 aggccaaggc aggcggctgg gaggtggagg ttgtagcgag ccgagatcgt gccactgcac
15781 tccagcctgg gcaacattga gcactgagtg agcgagactc catctgcaat cccagcacct
15841 cgggaggccc aggcgggcag atcatgcgcg gtcaggagct ggagaccagc ctggccaaca
15901 cggcgaaacc ccgtctccac caaaaaatac aaaaaccagt caggcgtggc ggcgcgcgtc
15961 tgcaatccca ggcactcggc aggctgaggc aggagaatca ggcagggagg ttgcagtgag
16021 ccgagatggc ggcagtacag tccagccttg gctcggcatc agagggagac ggtggaaagt
16081 gggagaccgt agaaagtggg agacgggggg agacgggaga gggagaggga tgtgcttttt
16141 ttctaaccgt tattgccacc aagtaataat gtcttaattc acaatttaca tagtgattgg
16201 ctggagagag gtattgagca taaatttttt tttaagattc aactgggaaa tggatgattt
16261 acatgatttt agtctcttta gttgtctggg tatttcttga ctgggaatag caatatctta
16321 aaggccattt ttaacaagaa tgctaaggat ggaacacttg aaggaagcag tcctgtacag
16381 tcaaatactt cagttacctt ggataataga atgaaaactc aattgcctac tttgaacaaa
16441 tttttttttt ggattttaat ggctggacag aataacattc tgctaatttt aatccttggt
16501 catttccgat gtaatggaaa atgcagtttg actcagaatc ggaggcctgg ggtttggacc
16561 ctgattgtgc caatttatgt gactttagat aaatcttttc atcagtctac cttaaagttc
16621 ttcatttcct ccagttccct aaaatgagga agttagtttt tagggtggtt atgagaacta
16681 aatgagagca cttgagagat cattcagcct gaagtgggta ctcagtatta gatggctaaa
16741 tctgcacagt ctagaatacc aggcaaaggt tactctgaag gtctttgcta ataacaaatc
16801 tttctctaag aaagtttgta aatgtgatgt taaactcaga aatgtcacat agaacatatt
16861 ggagcaatta ttgccgcaaa agtaactcgt agcaaccaca aaaacccagt ggtgtgcagc
16921 aataaacagt ttatgaatta gataagtgat ttcggctaga tgtctctgga gcagttgtag
16981 tctttcctcg ttcatgaggg agttggcctc acctggaagg acttggcatt tttccacatg
17041 cctcctatcc tccattaaac aagcatgttt ttgtggaggt tgtagaaggc aacaacagcc
17101 aagcccaatc ccataactcc ctttcatgtc tgcatgcttc atgctaacta gcattcacca
17161 gaaacaagcc acatggctaa acccagtgtg gaaaggcact acagagttat tagaccaagg
17221 gagagaacat aggaggggtg aagaattgga gccttaaatg cagtcaatct accacaccct
17281 tgctttgtat ttaacaggtt actgtactgg tttgccagca aacaatggaa aatgtggaga
17341 agctgaagaa tgctcaagct gggacttaat agagtggcct atttggtttg aaatgtttta
17401 acttacagag cattgagtag aagcctaatc taatatacat aaggaagaca aaagcaaagg
17461 attgtgtttt ctatctaaag gttaatcatt gtggttgctc ctggccatta tcacatgact
17521 ggaagttaac actctccaaa cgctgagcct atcctgtaca gcactagaaa gtagaaagaa
17581 tcactcaatt cagggaaacc gttttctctt aatgtgaaca tttacattaa tgccatttcc
17641 aaaacctttc tgggacttct taaatgcaaa gatgctatct gctttacttc atgctgcctg
17701 tttttaggag cttggagtgc tttaggaagc ttcccaatac tggtttagca gtaatttggt
17761 tgactgatca aggcatgttt taactttgac actgaaattt taaaaagaca acagttatct
17821 tgcccggaga gtcaagtttc tgcttccaag gaggtcagga attgttctct ttggtgatgt
17881 ggctgtgctt ggtagccctt gaaagtggag tcgacagcag tcctcagctt ttgtgtgcct
17941 gtcttagtct gttttgtgtt actataacag gatagctgag gcagggtcac ttatgaagga
18001 tgctcacagt tctacaggct gggaagttca agggcatggc cctggctttt ggcaagggct
18061 ttgctgctgc ttcatagctt gatggagaag gtcagagggg aagcagacgt gcaaacaacc
18121 cacttgttca caacaaccaa acaagtctct ttttaacaac ccactcctgg ggactaatct
18181 agtcttgaga gagtgagaac tcattgcaag agcagcacca agccattcat gaagcatctg TABLE 1-continued

| | | | | | | |
|---|---|---|---|---|---|---|
| 18241 | cctcagtgaa | ccaaacatct | cccactaggc | cccagctctc | aacaccacca | caatgaagat |
| 18301 | aaaatctcat | catacatttg | agggacagtt | tgggagacag | accatagcag | tgctcagtat |
| 18361 | ttctacccaa | atgttcaggt | aacttaatat | atttttcctt | gaatatatgt | ttaaatgggc |
| 18421 | ttcccttccc | cacgctcatc | ttgaatggtc | ccacaacaac | ttttgattat | cacgttcctg |
| 18481 | taaatacaca | aaaatatttt | gtggtctttt | actggcagcc | cagtggatgg | gactttaaaa |
| 18541 | aatcacccag | attccaacaa | ccagagaaaa | cgactggtgt | atatttttc | cagtctttat |
| 18601 | ttgtatgtct | gtgtatattc | aatggaaaat | gtttgaagct | tcactcacag | cacattccat |
| 18661 | tagagaaagc | tactaaaatc | ataaggaaaa | tctaaaatgc | agtaagccag | tcagcaagcc |
| 18721 | ataatgggca | tatgaaaaca | aagtttttg | ccatgatttg | tggaccacag | aagatctgtg |
| 18781 | ttattagtct | atttaagttt | ggtgtttgaa | attaaaaatg | ttcgacatac | tttttatgtt |
| 18841 | ttttttaaat | atactgtcta | tatttaaaat | tgagtatact | gtactttagt | gtgtttggaa |
| 18901 | gcagatatcc | ccaaataaaa | gtatacagta | gaaccaaaga | attttattga | tcagctagaa |
| 18961 | tttagttttc | aggtgtaata | actgtcaacc | taaataacag | aggctttcta | aaagaaaatg |
| 19021 | atgtttattt | gggaataggg | cattgtgaag | gcaatatgca | tgccatagta | aactgtgtgt |
| 19081 | attcaggaag | gtaaaggaag | acaggttttt | aaaggacaga | taaagattat | ataattgtct |
| 19141 | tgaaataatt | attcttggct | acaaggatta | ataacaagga | tgctgccagt | tcgggtttgg |
| 19201 | acaatcggct | tctaggcaga | tgtcccaaaa | gtattttctg | tgtaaggttg | cgaatagtgt |
| 19261 | ttgtgcaagc | tggcgtggtt | tcttctgggt | ctttgaggta | gtgcgtaaaa | tccctctctt |
| 19321 | catggacttc | cctggctcca | tttgtcaggg | cttttggaaa | catgactctt | gattctgaca |
| 19381 | gctttcacct | ttccctctct | tgatgaagat | gtttttccga | aagtatctat | gatgaatcat |
| 19441 | cttgtagtta | ggctttgatt | gtcccttggt | gacagaatag | acctttcccg | ggttattggt |
| 19501 | ctggtcctgc | atcctgcatt | ggcaggagtg | attggcaact | aaaagtcagt | gttaaaaccc |
| 19561 | ttttagccac | ctttgagggc | agggaggctt | taagggagtg | gcacttaggc | taagtccacc |
| 19621 | tggagtctat | tattaagtcc | aatttttttt | ccttagtcct | ttgttgtccc | ctcaaagtgc |
| 19681 | tgggctagca | ttattctgtt | aggaattgta | cttctttctg | cagaaaattt | ggcaaataac |
| 19741 | agatacaaag | tttaaaaagg | aaatacacaa | aattaatagt | aatgtgacaa | tcccagtttg |
| 19801 | cataatggtt | ttgagccctg | aacctaggct | tacaggcaac | caattgaata | aatcaaattg |
| 19861 | taatacaatt | cttgctctga | tgtcttagga | aaaatgtcta | cagcctgaaa | tcatcaactt |
| 19921 | tttgtcctgg | tttgcagttt | gaatgtctct | agctatggca | ttggttggta | tggtgaactt |
| 19981 | ttgtgtgacc | catacatcag | catgagactt | gctcctttaa | aaattaatca | catcttagct |
| 20041 | tataggcctc | agagcatggg | agtagttttt | tttcttagag | agtcatagcc | aaatattgaa |
| 20101 | ggaaattagg | aggattcagg | agcaaatcca | gtctgcaggt | ggataacagg | agtttcaaaa |
| 20161 | cggtacagag | ctgtgatcta | ataacaggta | catatagctt | tcttcagaaa | cttaaagtta |
| 20221 | ccctgatttt | taccaaagat | gttcagaata | aaacagattt | gtaaacttta | tcagattttg |
| 20281 | tctgcaagaa | tagtagtatg | gtcacagtaa | tctcagattt | aaaaacctcc | ttgaggctaa |
| 20341 | gaagctaagt | caaggtagac | tttagatttt | acctatagtt | ttaaggttcc | tgggcctgcc |
| 20401 | aggaaatgat | aatttttaat | tcagtgtaat | gctgagaacc | attgaagcca | ggcattctac |
| 20461 | acattctcaa | atatgacatt | ttaatcaaag | ccttggtaat | acaaccagtg | tttccaattg |
| 20521 | tatcctgtta | taacgagagc | cgatttttat | tgaacttagg | caaatcatat | tgccttaaga |
| 20581 | gtactcacaa | ataggctggg | cacagtggct | catgcctgta | atcccagctc | tttgggaggc |
| 20641 | caagacaggt | ggaacacctg | aggtcaggag | tttgaaacca | gcctggccaa | catagtgaaa |
| 20701 | cctcccccg | gccaccgtct | ctactaaaaa | atacaaaaat | tagctgggtg | tggtggtgca |
| 20761 | tgcctgtagt | cccagctact | tgggaggctg | agacagaatt | gcttgaaccc | tggaggcaga |
| 20821 | agttgcactg | aaacaagatc | gtgccactgc | attccagctg | ggcaacaga | gcgagactcc |
| 20881 | gtctcaaaaa | caaaaacaaa | tgaatactca | aaatagtttc | caaattggag | ggatcaagaa |
| 20941 | gaaaggaaaa | gcaaatattt | ctacctttgt | tcacaaaagt | attccaaatt | gctgtaaact |
| 21001 | atagatagca | tgagagaatt | tctttaaata | tggaaaacaa | aacatttaag | taaaaaaaca |
| 21061 | ataatgcttc | aaataaaagt | cacagacaca | tcttcagtta | cttagtctca | tgtaactttt |
| 21121 | tttgttgtgg | ttgatcttaa | ttagtagtta | catggactca | tcagtttctt | gaagttctga |
| 21181 | aaaaatattt | agtccattgg | tattaaagtg | attagtaacc | tgtatttaaa | agtgtgttag |
| 21241 | catcttttcc | atgaatctga | ttgcaaatgc | ttttagagaa | aaagcaataa | ctgggaatta |
| 21301 | caaaaactta | gaataaccat | gattaaaaat | ctgatgagag | tttaccataa | ccagaaatag |
| 21361 | acaaagagtt | ttggttattt | ttgtggcaaa | cagcataatc | agaattatga | ctgatgacat |
| 21421 | atttctaacg | gcatcgtaca | attttggaac | actcatatca | ataacatact | cataaatgta |
| 21481 | actgtgtcta | gtattacatc | attagacaat | gcttttcata | caatttaata | catcaaagaa |
| 21541 | gcctaattag | ctaacatctc | taccagatgg | catacacatg | ctctgaggct | ttccagaggc |
| 21601 | ccaagtggaa | aactcaaagg | taattttaag | tcaaaaacac | ttaatttaga | acttgagcct |
| 21661 | agagaagcct | gtcaaagatg | tcaaaagttc | gaaacaggat | cacaggtcac | tataaaatat |
| 21721 | ttaacaagaa | tgataatcaa | aagacttaag | aagcaatgca | gaaagttaca | tacatttaaa |
| 21781 | aaccatcttt | tcaaagcttc | atttttccca | agcaaaaaaa | aaacttaaac | acaagaattt |
| 21841 | atcttgatag | aacataaaat | ttttcttagg | ccagttgcca | aaatggtaaa | gaaaaatctc |
| 21901 | ttgcagtgtg | actgccttta | cttatgggaa | gcctatttgg | atatactgaa | agttgaatct |
| 21961 | gatgaaaagg | tacttgaatt | taatcagaca | caggaagagt | atttccaagg | ttatgagtgt |
| 22021 | acgccttata | gaggaatgta | aataagaaag | ctagtatgtt | gaacagaata | catggctctt |
| 22081 | ggaaaaatta | cgagaaattt | cctgcttgcg | tggaacaatt | caaacatgag | aagagccaag |
| 22141 | aattcagaat | caagttatac | tggaggaaaa | cattgctttt | ctaggccttc | tacagaacat |
| 22201 | ttcagtatca | agttataaca | gcaagagtta | gaaccagagg | aaaaaagtta | caggagctaa |
| 22261 | tgaaaaagtt | aagagttatc | acccctgcca | aacaaaaaga | tgtaccttct | taaggggaga |
| 22321 | aagagctaaa | ggcaatgatg | tgtgacctac | aaataaggtg | cagcaagata | cagcaaaggt |
| 22381 | tgaacttgtg | agatataaat | caggatcttc | aagaagaaaa | ctctacctca | agaaatgaaa |
| 22441 | tgaccatctt | aaatgaaaaa | agacagcctt | tctaacctga | atctagggga | aattaaacgg |
| 22501 | atctcagaag | gaaatatggc | agaaatttaa | actgtggttt | agaagatggc | tgattttaga |
| 22561 | attaaaaatt | aaaacctctt | tcaattttat | taagaccaga | tccttaaaaa | gaaccttgtt |
| 22621 | ctaacattgg | ggaccaaatt | ttgtgtgtgt | gtgtgtgtgt | gtgtgtgtgt | gtgtgtgtgt |
| 22681 | gtgtgtatag | tgcatgtata | gcatttacac | tatcgtgtat | atacaaatat | atagcatatg |
| 22741 | tatagaatat | actgtattat | tgtacatata | catatgtaca | agtatatatg | taagctcaat |
| 22801 | gtcttatgat | ttcattctga | cctattgcca | acttcattac | acacaactcc | tttcataaat |
| 22861 | gtatccttca | tgaacatttc | atgatctgca | cagaccttca | gtgacatgct | taaactttct |
| 22921 | gctttgtttt | atacttcccc | ttaaacaact | ggtcatcctg | ctttaggata | aaaagttact |
| 22981 | atgcaagact | catacagaat | tattctgtta | attttgtaac | cttccttacc | aaaggtacat |

TABLE 1-continued

| | | | | | | |
|---|---|---|---|---|---|---|
| 23041 | tctcacaccc | attaacttcc | ttcatatttc | tctcctcctc | ctacttagtg | gttcctttct |
| 23101 | gtcttgtttc | catatttgaa | acaacctcta | ataaactctg | aatttaaaca | actttttttcc |
| 23161 | caataaaaag | caatttttat | gccttataac | ttttctcatc | aaaacatctt | tttttgggta |
| 23221 | cactttgtat | atggaattgt | gtattttcaa | attttaactt | attaacctta | atttttagtg |
| 23281 | aaaacctagg | aagcaaaatt | ttgaagtgtt | atatcagcat | tttataaatg | agaaccatat |
| 23341 | tataattttt | agaaacatgt | ttccttataa | ctttgtatat | taataggccc | aaatatattt |
| 23401 | agtctttcta | taatttagga | agccaagaac | aaactaatat | tttcagcagt | ttattgtttt |
| 23461 | tttttggaaa | tgatccagac | atttactgaa | gattaattta | taagatttca | aattacatga |
| 23521 | aaagttcatt | aacatcctat | ttttaaaaac | attcttttgg | tttatttttt | agagacaatg |
| 23581 | tcttgctgtg | ttacccaggc | tggagttcag | tggctgttca | caggcacaat | tgtagcacac |
| 23641 | tgcagcctca | aactccaact | cacacaatcc | tcctgcctcc | gtttcctgag | tagctggaac |
| 23701 | tatagatgca | tacctgcata | ccaccatgtc | tcacccttgc | ttatcccgtt | tataatccat |
| 23761 | ccaattcttt | tttttttttt | tttttttgag | acggagtctc | gctctgtcac | ccaggctgga |
| 23821 | gtgcagtggc | gtgatctcgg | ctcactgcaa | gctccgcctt | ctgggttcat | gccattctcc |
| 23881 | tgcctcagcc | tcccgagtag | ctgggactac | aggcgcccgc | caccgcgccc | agccaatttt |
| 23941 | ttgtattttt | agtagagacg | aggtttcacc | gtgatctcga | tctcctgacc | tcgtgatctg |
| 24001 | cccgccttgg | cctcccaaag | tgctaggatt | acaggcgtga | gccactgcac | ctggcccccca |
| 24061 | attcattttt | aacaattatt | cctagattac | ttataaaaac | tgagatatta | gacatagcta |
| 24121 | gtcatttcaa | gttattttcc | tgttaaccat | ttttattacc | tgtgagtatc | atgtgttcaa |
| 24181 | ttaagaacca | taaaaatgaa | atatgtaggt | attttgccag | taactcagag | gacacagctg |
| 24241 | aagtcaataa | tacaaaatta | gttcaactta | cagttataca | aagatcattc | tgtttttaag |
| 24301 | ttgagtttat | agttttatga | ccttaaaaag | tctaacagag | acaaatataa | aactgagtag |
| 24361 | taaattcagg | caaaaatttt | aaagacactt | atttttgatt | taccaattat | tttaaaacca |
| 24421 | gcttatcaga | tgtttaagtt | atattaacta | aaaggcactt | gtgttaatta | ctatatattt |
| 24481 | tgtattagca | ctcatttatt | tgatgaatag | aattccttaa | gggatttgtg | gccaactgcc |
| 24541 | agattttacc | acgtagacac | aacatacaac | atatatatac | atatgtgtaa | acacacctaa |
| 24601 | acatacacat | acacaaacat | agctttcatt | ttagaatttt | agtcatacga | tagtaataca |
| 24661 | ggcttgctgg | tttataaaag | acagttattg | gattcaaatt | atatttctga | gaaagtggga |
| 24721 | cctgctcagc | tgggtaaaca | tgcagaatag | gtaatcttat | gaaagctgtg | aaccaaaagt |
| 24781 | tttggtaaat | agcagtttgg | atttttaaaa | aacctcttac | cccacctccc | caacccctttt |
| 24841 | tttccctttt | ttcagtttca | aatgagttta | atgttaatat | ttaaatgctt | acatttttag |
| 24901 | ctaggactgg | ctgaattgta | taagaaaaaa | caatctccag | gtggccttga | atttttagta |
| 24961 | acaaatcttt | tgtttgccat | tctggttttt | ttgactagtc | agtgcaggca | gggaagcatt |
| 25021 | ttagcagttg | tggatgaggg | gtttttgttt | tgttctttta | gcctttgcat | agcaggcaag |
| 25081 | caatttttat | gctataccag | agatacctta | tattattgcc | ctgagctcaa | gattttgacc |
| 25141 | tgtttgagag | cctaattttt | atacgtattt | atctagttct | tttaggctat | taatccttta |
| 25201 | attaactgtt | ccatcaccct | aagcagttat | taggcaaacc | taaatttaca | ttaaaaggga |
| 25261 | tacttcttaa | ttctaggtgt | tggttgccag | ggaactatta | taatttataa | agccattaat |
| 25321 | ttaaggccct | ttaagacctt | tttttttctt | tttgttcttg | gctggaatgc | cgtaaggagt |
| 25381 | gagtttcatc | tcaacactgg | cagaaacagc | agatttaaag | taggcagaaa | aaaaattaga |
| 25441 | gagcttagaa | gactctacat | atcaactcta | tagctgcagt | ctcttggtac | taagaataaa |
| 25501 | aaagcttggg | gagtttagac | aaagcataga | caatctctat | gatggtcatt | gatccaaaaa |
| 25561 | catgcatgag | gaaaagccac | atagctgacc | tgaagtccca | gaaaagcagg | catgccttaa |
| 25621 | tgtttgagaa | tttccatttt | gtttcttctc | aatctcttaa | gagcaaagaa | aattctgtaa |
| 25681 | atcctgacag | ataagtcagg | tgtttggacc | agtgttttaa | ctggtggcga | ttgccctagt |
| 25741 | ggctttaaaa | gagccatcct | gtgcccaaaa | tttagaatgt | ttatttttgc | tcttgggaga |
| 25801 | tgttcagaaa | caggggaaaa | gagccaaatc | atttacagat | gcatgtaacc | atatcgaaac |
| 25861 | gaaaccaaaa | tcagtgttcc | caaaagtgtt | aacccagtca | tgcagattaa | aaaataatat |
| 25921 | aaacacagaa | gaacccaaag | taaatttacc | agaaaaggca | tgcctcagaa | tccagagtac |
| 25981 | tcagccaggc | gcagtggccc | atgcctgtaa | tcccagcact | ttgggaggcc | aaggcaggag |
| 26041 | gatcgcttga | gcccatgagt | tcaagaccag | cctcagcagt | atagtgagac | actgtctcta |
| 26101 | aaaaaaaatt | gtttttaaat | ccagagtact | caaaccagag | ggacacttgt | ctttatatca |
| 26161 | aaaaggactt | gccaggaaag | acaaaaagtc | ttttgtcatc | ccaggaggga | tgtaaagtcc |
| 26221 | tttattaaag | tggtcttaga | accaagacaa | atccaaagtc | aagtcaaaaa | gcctctgcca |
| 26281 | aaagtgggag | gctctgcctg | agaaaagact | cactggggca | gaacagacaa | gctatgtaag |
| 26341 | cggagagccc | aaagggctcc | tgtgagtact | gcatactgat | tctgagatca | ccacttctct |
| 26401 | ctgaaatgtg | tcctacttca | ggttctactg | ctgaacacca | tttatgtcaa | cacagagaga |
| 26461 | ggctctctaa | aagaaaactc | tatttgggaa | tacagcattg | ctgtagaaat | acgcatgtca |
| 26521 | tgggccgtgc | gcggtggctt | atgcctgtaa | tcccagcact | ttgggaggct | gaggtgggcc |
| 26581 | gatcacgagg | tcaggagttt | gagaccagcc | tggccaacat | agtgaaaccc | cctctctact |
| 26641 | aaaaatacaa | aaaattagat | gggtgtattg | gtgggtgcct | atgatcccgc | tacttgggag |
| 26701 | gctgaggcag | aagattggct | tgaacctgag | aagtggaggt | tgcagtgagc | ctagatgtgc |
| 26761 | cactgcactc | cagcctgggc | gacagtgcaa | aactacgtct | ccaaaaaaaa | aaaaaaaaga |
| 26821 | cccatgtcat | ggtaaactac | gtgtgtattc | agggaagtaa | aggaagacaa | agattttaaa |
| 26881 | gaaaaatgag | ggttgtataa | ttgttttgaa | ataattgtcg | ttggttacaa | agatcaatag |
| 26941 | caagggtggt | gccactctga | agttggacag | gcagtggcta | ggcaaaagta | ttttgtgggt |
| 27001 | aacctttgtg | aaaggttgca | gtttttgtaa | cacaagctgc | tttattttcc | caaaagcttt |
| 27061 | cacagtacat | agaaaatata | ttggacgtgt | attaaatgtg | ccaaattagt | cagcaatatt |
| 27121 | acattaaaat | atgtgttatt | acttgttaat | gttcttaata | agttgttcag | gcagttatac |
| 27181 | cagactatct | tttctcattt | tccaatttat | aagtgtatta | tccaaaaatg | ttagttttag |
| 27241 | ggtgaccact | gtatattttg | gtatttttta | aagctaccca | attgtgtata | atttataaaa |
| 27301 | atcttttttt | cataagacct | aaaacttctg | aacaatacat | aggtgcaaat | aaataaattc |
| 27361 | ctttttatct | caaactcact | tccactgccc | tccctgaaga | aagccttttg | ttattgttgt |
| 27421 | cttgactaaa | tgtggcatgg | gagctaacat | tttcaaggga | agctgatctt | atctccgggc |
| 27481 | tctagaagcc | aagacatgag | gtatgtgttt | accgtctctt | aggtgactct | ccagaacttt |
| 27541 | cattctcaac | ctcctccctc | actgccagtt | cctcctcagc | ttcttagcca | agtggtagag |
| 27601 | gaaaaatggt | attttatgtc | aggactaagc | catgtgctct | gagccctggg | taagtctgca |
| 27661 | aggcttctct | agaactcata | cataggtcaa | ttattcctcc | tctgaaaact | taaactctgg |
| 27721 | caccactagc | tttttcctac | agcatacatg | ggctcagtaa | atcctctgtt | aagacaacag |
| 27781 | gaaaattaag | acaatgtcct | tgcaagcccc | ataactactt | tctatccctg | ctattcacag |

TABLE 1-continued 27841 ccaagtgtgt cgagaccagt tcacacaaac cttgttgatt ttcggtttca ccccctcctt
27901 actaaatcac ccctccattt gctgcagttg cccttgcgtg ctgtactcag acttggagga
27961 agtgatgtct tattcaaggc cagtttttgt actagtggtt aaataaatgg tttccaaatt
28021 ggagtcagaa ggagagcttc taaaatgtag gttccctggc ctcaattgtg agattctgct
28081 ttagcaggtc tggaattgga gcactgggat ctgcattttc agaaaaccca aaatgattat
28141 cagccaggac ttaaacctct gctttagacc acattccctg tgggctttca gattttctat
28201 caatgttctt ccctcttccc agctcccaca cattaaaact cagatcatgc agaaaagaag
28261 ttacagttcc ttcatttcac atcaatttct catgcatccc atctggtttt gggaaggtgt
28321 gggacgaggt ggatggcctt aaacttgcca atcaaagata acgttctctt tcgattcaaa
28381 tagcctatct caggcttaaa accatctctt tggataaatg ctcagctttt caaaggttct
28441 tcctagcttc ttcctcatga tggcatctag tgggtgagaa cagtcatctc caggtgacac
28501 aggaaagagt ttctctaatg tatgtgctga ggtccttgac ggtcctgctg ctggtgctca
28561 tcctgccatc tttgctggat gtcactgagt ctactgggta atgtaagtgg gtccctggct
28621 tttgttcact gctgtcatgc cctgctcctg accacaactc tgtcattgcc tttggtctca
28681 aggtctctac cttaatagct tccatgtccc aactatggga ctgttaatct gctgggcttt
28741 ggagtgggtg ggaagggatg atgttggaac tttgggatgt actgaacatc ttgctcaagc
28801 tttgggaagc caacattttc tcagactgac tagacacctc cttccaccaa tgctgagcta
28861 gtgctcctgt gccatactgg gtaagcctct aagtcatgag taggactttt ttgagtggct
28921 tgcagtcttc cccaggctat gccaggaaag tagttgacta accctgctgc tccaagactc
28981 gcatacccat cctgaagttt ccgtttattt cccaacaggg caattgcaat ctcaatcaat
29041 ctctccctgc cctgggagtc attccactcc tgcctaatga agagactctt ctcacatcgt
29101 attctcagtt tctcttatcc atggttagga gtaaaactca tgttcagttg tccaagcttt
29161 gcttttagta tgtgaatgga gctcttagca tgtagaactc ccttctcatt ctcagtaaag
29221 tctgactttg aagactactt atcatcttcc tagagatgcc aaagaataat caagataata
29281 aaggcaggct ctgagattca cagctgagta gcaactgtgc tgttactcta gtacacaccc
29341 tctcctttcc tgtgactgtc aggcttcagg gcttaccttt attggaaaga cagcaggggg
29401 gcatatatga agaaaatgga atctttaata ttgtcaaagt cttgacccaa tagagacatt
29461 cttgccccag actctcttgc ttcagtgcct ttgcctgttc tggtcctaag taccttgaat
29521 atccttctct tgatgccctg atataaaact ctttattcct caaagccaag ttcaggttat
29581 cacctccacc acagactttt ctttccctcc ccaaacttca ttgcctcttc tcatcactcc
29641 ctttgtaatt tgtttatact ggtaagagag cattcatcat aattaggcct atctatgcct
29701 acctttcttg ttaaattatg agctttgttc tgccttggat atctctctgg cttggatatc
29761 tctctggcct ttgctctgca cttccaaatg tatccattat tcaagaccca ggtttccagc
29821 ctgatcaaca tagcaagatc ccatctctcc aaaaaaaaaa aaaaaaaaaa attgtggggc
29881 cgggtacagt ggctcatgcc tgtaatccca gcactttggg aggccgaggc aggtggatca
29941 tgaggtcacg agtttgagac cagtctggcc aacatagtga aaccccatct gtactaaaaa
30001 tgcagaaaat tagccgggtg tggtggtgtg tgcctgtaat cccagctact cgggaggctg
30061 aggcaggaga atcgcatgaa cccgggaggc agaggttgca gtgagccgag attgcgccac
30121 tgcactccag cctgggtgac attgcaagac tccatctcaa aaaaaaaaaa aaaaaaaatt
30181 agctgggcat ggtggcaggc acctgtagtc ccagctactt gagaggctga ggtgggagga
30241 ttgcttgagc ccaggaagtc gaggcttcat gagccatgtt tgtgctactg cactctagcc
30301 tggatgacaa agtgagatcc ttttctaaaa ataaggaccc agtttatttt atttagttat
30361 ttagttattt ttgagaccaa gtttcatcac tcaggctgga gtgcaatggc acagtcttga
30421 ctcactgcaa cctctgcctc ctggattcaa gcaattcttc tgcctcagcc tcttgagtag
30481 ctgggattgc aggtgcccgc caccacacct ggctaatttt tgtatttttg gtagagacag
30541 ggtttcacta tgttggccag gctggtctca aactcctgac ctcaggtgat ccacctgcct
30601 tggtctccca aactgctggg attacaggtg tgagtcaccc tgcctggcca gaacccagtt
30661 taaattccat cctctctgca gagtcttcct taaccacccc tattgaaagt tacccctgct
30721 tcctacaaga agtggtactt ggatgttcat gagatacctg tgcaaggctc ctgtgggggt
30781 cctggggaga cagtgacatg gacactcatg aaaggaacct tggaatagcg agtgtgtgtg
30841 ctataaaatg tgctttagat ttgattacca ccacttaagt tatgagctct gatatggttt
30901 gggtctccat ccccacccaa atctcatctt gaattgtaat ccctacatgt tgagggaagg
30961 aagtaattgt attatggggg tggttctccc atgctgttct catgatagtg aattctcaca
31021 ggatctgatg gttttataaa tggtagtttt tcctgtactt tcacacactc acactctctt
31081 ctgccacctt gtgaagaagg tgcctgcttc cccttctgcc ataattgtaa gtttcctgag
31141 gcctccccag ctgtattagt ctgatctcac gcggctaata aagagatacc ggagactggg
31201 taatttataa aagaggttta attgactcac agttttacat ggctggggag gcctcacaat
31261 tatggcagaa ggtgaagggg gagcaagaca catcttacat ggcatcaggc gagagagctt
31321 gtgtagggga actcccettt ataaaaccat cagatctcgt gagacttatt cactattaca
31381 agagcagcac gggaaagacc cacccccatg attcagttac ctctcactgg gtccctcaca
31441 taatatgggg aattatggga gctccaattc aagatgagat ttgggtgggg acacagccaa
31501 actatatcac cagccatgtg gaactgttga gtcaattaaa cctctttcct ttataaatta
31561 cccagtctca ggtatttctt tatagcagtg tgagaacaga ctaatacaag caccttgagg
31621 tcagaggcta aaatcacttt ttcccaaaca tttccttttt atatatgcta catctttgtg
31681 tctgcttcaa catttccagc agtgctttat atatggtagg catgcaataa atgcttcttg
31741 atcgactgac aggtgctcag aagatctagg ttggttgatt ctcttgtgat gccatctttt
31801 cctgagagct cattaatttt taagttgttt tccttgaaat gcatggtatg tttcctccac
31861 cctgctcttt gcctttcata gggttccatt ttgatcagct gctctcattg tctgttttgt
31921 gatcaaaggt tctgatgaac tttggaatat gtgtatgttt ggagtgagga tggggtctgg
31981 aggagatgca tggttgagga ccaattcacc caacccagct tacagaagta aagcggcccc
32041 ttaggagcac tgaagcattg ctgtggattt cagaattacc ttatttcttt ttcttttttt
32101 tttttttttt tttgagacga ggtctcgctc tgtcgcccag gctggagtgc agtggcacaa
32161 tctcagctca ctgcaagctc cgcctcctgg gttcacacca ttctcctccc tcagcctccc
32221 cagcagctgg gactataggt gcacgccgcc acgcctggct aatttttgta tttttagtgg
32281 agacagggtt tcaccgtgtt agccaggatg gtctcaatct cctgaccttg tgatccaccc
32341 gcctcagcct cccaaagtgc tgggattaca ggcgtgagcc accgtgccca gccagcttct
32401 ttcaaatcag agtaggcctt ccagtgtggc aggccataag atctgaagtt ttcaccctgt
32461 tcctggaagc caagtggaca gcaactaatt tttactttct ttattgcaca tttggggctt
32521 gggggataga gtcagatgtg tgtcagttga aactgtagct actgcattcc actccttggg
32581 ggatcgtagt gctcatgcca acagaaaact tcgaggctaa taattactgt cttcagagta TABLE 1-continued

```
32641 caagacaggc acggaagttg ttttggcata agaaaaccac gatttgcatc ccacagtcta
32701 aggaagacga tgctgaattc agaagatggt gcaaaagtgt gacagttcag ctgtggcggc
32761 tgttgctgat gcatgggact attttattta catttccttt cttctttttt aacagagaca
32821 ggatcttgct gtgttgccca gcctggtctt aaactcctgg gcccaagtga tcctcccacc
32881 tcagcctccc aacgtgttgg gattacaggc atgagccacc atgcctgggc tttatttata
32941 tttccaagtc aaatgttagt tggtcaatca gtctttttaa gcaccaattt tgtgcctagc
33001 cttgtggaaa ctgtaggaaa aagatacttt ttatttggga ggaccttgat ttgctgtcac
33061 aggtgccact aatgccaatt ataaggcagt gtggaatcag gtgattgaaa gcccagtctg
33121 tagcataaac tgctgcaggg ttccagtggg ggcaattaag gtgggcaggg agggtggata
33181 gcatttgact ttgacagcat aacctgagca gaggcacagt ggggatggtg agtgtgcagt
33241 gggaggaggg agagaggtaa gtggtaggga agaggtggga agggggcaag gagaaggctc
33301 aggaggtttg gggacaggga aatgacttgg ttggcgacct cttactttct tctcgtgtgt
33361 gcaatttgga attcacttgg ttcttagtat ttctgggtca gatgacttct ttgcagtatg
33421 agaaaccatt tcccaggctg gctacctggg ctgtggtatc ttccagtgct cctctgtgat
33481 tgtactcaga tcagctcgtc taggcaggca ggatggcaga agccctctga cttcatgtct
33541 gaaagagtat gtgtttcaac tctgtaatta cagcatttaa cagacgatat cagccctctt
33601 tgggatggct tttggcaaat gggctagaag tctattgtgc atttaaatga tactgcatct
33661 tctctttaaa aggtttctca gtgagtccac cccactctgt atccaagtat gtctcaggcc
33721 atgaggcaaa aggaaatgag tagttctttt tggttggaga attaaaaaga aatctccacc
33781 caagtaacag gtacatagtg ggaaaaaata acatctgcct gaaagcttca tcttcaggca
33841 aagagagggt caggggcgg gagcttagta atggggaaac ctcagaagat ttaaagagaa
33901 ttacagacag acaaggctga acattggctg tcatccaaca aagctcttat aagatgggaa
33961 tcactgcccg gttcttgagc tccgacctgg agggaagagg agtctggaag acttggcaca
34021 ggcctgagtg cttcattgtc tttctggttc caagtcctcc tcagctcact aggaaggagg
34081 tggggtgggg gcaggtaggc cactctgcat aagtgcacac atctacactg gctagtctac
34141 ttcacaattc ccccacaggt tatccttatc tctacctggt tccagttcca gattggaggg
34201 atatagaata ccatccccac ccctcacctt gcttgctctg gcctggaaaa ctgtcattcc
34261 tttaccacca gctggcatct gccatatgct tcaaggaact gaataaagag gaaggggaaa
34321 gaagaaacta gagaaactgg aatgcttcct atctgacccc caagtacagg gactgcctct
34381 ttccgtaacg gcacagaacg tctccatccc tttgacctcc acctccccag agatgcccga
34441 ggaggacagc cttgtttctg tgatctgttg ttgagaactg ctgctgagaa ttcttccttc
34501 agcaccgcct taggcaccat tggtttttca ctaggtccgc tgtagaaaac agccaggaat
34561 tacttagttg actaccacct gaggtgctgt ttggtgttgg taataaagaa taaaggtgga
34621 aatgaa
```

SEQ ID NO: 6 Fkanan SMARD2 Isoform 1 Amino Acid Sequence (NP_005892.1)

```
  1 mssilpftpp vvkrllgwkk saggsggagg geqngqeekw cekavkslvk klkktgrlde
 61 lekaittqnc ntkcvtipst cseiwglstp ntidqwdttg lysfseqtrs ldgrlqvshr
121 kglphviycr lwrwpdlhsh helkaience yafnlkkdev cvnpyhyqrv etpvlppvlv
181 prhteiltel ppldddythsi pentnfpagi epqsnyipet pppgyisedg etsdqqlnqs
241 mdtgspaels pttlspvnhs ldlqpvtyse pafwcsiayy elnqrvgetf hasqpsltvd
301 gftdpsnser fclgllsnvn rnatvemtrr higrgvrlyy iggevfaecl sdsaifvqsp
361 ncnqrygwhp atvckippgc nlkifnnqef aallaqsvnq gfeavyqltr mctirmsfvk
421 gwgaeyrrqt vtstpcwiel hlngplqwld kvltqmgsps vrcssms
```

SEQ ID NO: 7 Mouse Smad2 transcript variant 2 mRNA Sequence
NM_001252481.1; (CDS: 443-1846)

```
   1 ggttaaaata actatctgag atttgttttg ctgttgttgt tgtttaagga aaattaaggt
  61 agtaccatat cttaaatcat tgcaacaaga ggcagtattg ctacttataa aagtaaataa
 121 tagtgtataa aattgtgttt caaccgaatc ttactggcat ctttctctct ttcttggaaa
 181 cactccatga aacaatagat gcagtagatc aggatgatgg ggacgggaat gggggcacta
 241 ctacactact atactactac actctaggat gcgaggctgc atgcagagtt aacaacagtc
 301 agctgactgt ttacctgaaa gactggcata gaataggaaa atttggtgcc aagtgcataa
 361 aaataagcaa atgaaaagac attaattctg ggtagattta ccgggctttt tctgagtgtg
 421 gattgttacc tttggtaaga aaatgtcgtc catcttgcca ttcactccgc cagtggtgaa
 481 gagacttctg ggatggaaaa aatcagccgg tgggtctgga ggagcaggtg gtggagagca
 541 gaatggacag gaagaaaagt ggtgtgaaaa agcagtgaaa agtctggtga aaaagctaaa
 601 gaaaacagga cggttagatg agcttgagaa agccatcacc actcagaatt gcaatactaa
 661 atgtgtcacc ataccaagca cttgctctga aatttgggga ctgagtacag caaatacggt
 721 agatcagtgg gacacaacag gcctttacag cttctctgaa caaaccaggt ctcttgatgg
 781 ccgtcttcag gtttcacacc ggaaagggtt gccacatgtt atatattgcc ggctctggcg
 841 ctggccggac cttcacagtc atcatgagct caaggcaatc gaaaactgcg aatatgcttt
 901 taatctgaaa aaagatgaag tgtgtgtaaa tccgtaccac taccagagag ttgagacccc
 961 agtcttgcct ccagtcttag tgcctcggca cacggagatt ctaacagaac tgccgcccct
1021 ggatgactac acccactcca ttccagaaaa cacaaatttc ccagcaggaa ttgagccaca
1081 gagtaattac atcccagaaa caccaccacc tggatatatc agtgaagatg gagaaacaag
1141 tgaccaacag ttgaaccaaa gtatggacac aggctctccg gctgaactgt ctcctactac
1201 tctctctcct gttaatcaca gcttggattt gcagccagtt acttactcgg aacctgcatt
1261 ctggtgttca atcgcatact atgaactaaa ccagagggtt ggagagacct tccatgcgtc
1321 acagccctcg ctcactgtag acggcttcac agacccatca aactcggaga ggttctgctt
1381 aggcttgctc tccaacgtta accgaaatgc cactgtagaa atgacaagaa gacatatagg
1441 aaggggagtg cgcttgtatt acataggtgg ggaagtgttt gctgagtgcc taagtgatag
1501 tgcaatcttt gtgcagagcc ccaactgtaa ccagagatac ggctggcacc ctgcaacagt
1561 gtgtaagatc ccaccaggct gtaacctgaa gatcttcaac aaccaagaat ttgctgctct
1621 tctggctcag tctgtcaacc agggttttga agccgtttat cagctaaccc gaatgtgcac
1681 cataagaatg agttttgtga agggctgggg agcagaatat cggaggcaga cagtaacaag
1741 tactccttgc tggattgaac ttcatctgaa tggccctctg cagtggctgg acaaagtatt
1801 aactcagatg ggatcccctt cagtgcgatg ctcaagcatg tcgtaaaccc atcaaagact
1861 cgctgtaaca gctcctccgt cgtagtattc atgtatgatc ccgtggactg tttgctatcc
1921 aaaaattcca gagcaaaaac agcacttgag gtctcatcag ttaaagcacc ttgtggaatc
```

TABLE 1-continued

| | | | | | | |
|---|---|---|---|---|---|---|
| 1981 | tgtttcctat | atttgaatat | tagatgggaa | aattagtgtc | tagaaatgcc | ctccccagcg |
| 2041 | gggaaaaaga | agacttaaag | acttaatgat | gtcttgttgg | gcataagaca | gtatcccaaa |
| 2101 | ggttattaat | aacagtagta | gttgtgtaca | ggtaatgtgt | ccagacccag | tattgcagta |
| 2161 | ctatgctgtt | tgtatacatt | cttagtttgc | ataaatgagg | tgtgtgtgct | gcttcttggt |
| 2221 | ctaggcaagc | ctttataaaa | ttacagtatc | taatctgtta | ttcccacttc | tccgttattt |
| 2281 | ttgtgtcttt | tttaatatat | aatatatata | tatcaagatt | ttcaaattat | catttagaag |
| 2341 | cagattttcc | ttgtagaaac | taatttttct | gccttttacc | aaaaataaac | aaactcttgg |
| 2401 | gggaagacaa | gtggattaac | ttggaagtcc | ttgaccttca | tgtgtccagt | ggatcttagc |
| 2461 | agtcgttctt | ttgtgagcct | tttctcctga | gttgcattag | aaggaaacct | tactggaacc |
| 2521 | gtccaggctc | ctcatcccat | tcctgttctg | gttcagagca | gtacagcaga | atgacgtcgt |
| 2581 | gctaaacagt | tgcactgctg | gcttctgggt | tagttgtttc | tgagtccagg | aaaggtttgt |
| 2641 | gtgggcagta | agtccttttg | tctaataacc | agacttcagc | agatgataac | tgatgtgtat |
| 2701 | aaccagttgt | tctgttgatt | aacttttgtc | tcaaacatgc | acaggtggca | gtataattat |
| 2761 | tttcagggct | attctagaat | catctcagtc | tgtttccttc | ttccaaagcc | agtctaataa |
| 2821 | taaagtacct | ttctgtaaag | gcagccgacc | ttttgcctca | ttttactttt | actaccaggt |
| 2881 | tgtattacag | aacagacctt | ttgtaaatgt | gttagagtga | cgctgaggtc | ttgtcagcag |
| 2941 | atagggccat | ctgtttttaa | agtgtattgt | atgtaattta | taagtagaat | gttattttac |
| 3001 | ctagcttcaa | aggtttaaat | attgtgagct | aagccattta | gcaagatttc | tagcccgcag |
| 3061 | ttagctgtgg | acttagctct | tcctgactta | ccctgggtgt | gtggtttgct | gacctttcag |
| 3121 | ctctgcagga | aggagatccc | agctgtcctt | tggtcctccc | ttctgcagca | cacgacagtc |
| 3181 | atgtccagtg | ttgactcctt | tctcgtttgc | aactccgtac | aaatgcctgg | tctccttttt |
| 3241 | gtaaactttc | atatttttgc | agacaaatac | ttttggtact | tactctttga | gaccattctc |
| 3301 | acatgtatgt | acagtaatca | tttttgatgc | ttttcaacat | tggttgtttt | ctatttgata |
| 3361 | tttctcattt | tcctatattt | gtgtttgtat | gttatgtgtt | catgtaaatt | tggtatagta |
| 3421 | atttttattc | aaatatttat | tgttcacctg | ttaatgtgcc | atgaacttcc | ttaacttttg |
| 3481 | ggtgaaggtg | aacaagatag | ctatagttcc | tgcctttgct | aagagcagtt | ggtttaaccc |
| 3541 | atactcaagt | gtctgcatag | gaggtaaaca | gggtatactt | tgagaatggc | agagacgatg |
| 3601 | cttttggtag | gatattagga | aggcatctgg | agagtgatgt | gtaagctaac | ccctgaccta |
| 3661 | ggaagagaaa | gccatgtgaa | gagccaaggg | caatttaaca | ctgctggaac | attatcagca |
| 3721 | tccaaaggct | caggctcata | gagactcact | gtcaggtatc | atgattgtgc | acacacctgc |
| 3781 | acacacccac | acgtggtgat | gaaaatgctt | gttcagttta | gaatttgttg | aaggtgggac |
| 3841 | tgctttgtga | caggctgctt | ctgtcatctc | actgtaatct | attcctcaga | ccttgtacag |
| 3901 | ctttcttaca | ccaggtcagt | gccacttaat | ttaacaactc | ccgttacgta | aatgctcacc |
| 3961 | agtctggagc | ctccctgctt | gcttctggac | gtgttgctgc | atatcggcta | tcactgcttc |
| 4021 | ccttccgctg | cccatcttgt | gatagagcaa | ttgtcctgtg | cattattgct | gttgagccta |
| 4081 | ctggagatcc | ttgtacataa | actgcccctt | ctctggaagt | ttccacagac | tagaaaactt |
| 4141 | gagctgttgg | gacagttctg | gggcagagga | cagctttgaa | agtggtagga | ggttatcaga |
| 4201 | catgttaaag | tgttgccaac | agtgagacac | agctccatgg | ttggggttca | ggaataggtt |
| 4261 | ttctatacca | ccgagcgtga | acaagtcacc | gtgtaaactc | atgtgaaaag | aattcagtgc |
| 4321 | ttatctttgc | ttttcaccgg | aatgctgtgg | gcatgcgcta | ctgtcaccta | gattttgttg |
| 4381 | atttcacctc | ttttgcaaga | ctgatttttg | ttccagatga | ttcctacggc | ctctcttggt |
| 4441 | tgatttatat | tgatttaatt | tctccacatt | atttagcatc | atgtctcagc | agtaatttga |
| 4501 | aagcctttct | accagattca | aacatttggt | tgtattaggc | cagtcttttg | gaatgccact |
| 4561 | aaactgggct | gtgacttaag | gaccctttcc | tgctagggtc | tgagccacac | cagttagact |
| 4621 | tactatccat | cgttatatac | atttagtcag | catagttcct | gcctattgtt | tacccagcca |
| 4681 | atgtgattct | gggaccatgt | cctggctctg | gagttgggct | tagtcctgtg | agagttcctg |
| 4741 | ttgttttcag | ggcctatgac | tttgccagaa | ggaatttgca | tatgttttct | tgagagctga |
| 4801 | atcttctaat | tgtgtacata | tatgtatgta | tatgtacaga | gttccttctt | tgtttcttta |
| 4861 | atttcacctt | catcacgcct | tggttgtcag | ttcatcccga | ctaagagtcc | aagtcagtca |
| 4921 | ggttagtagg | cttttgctgg | ttgaagtcaa | agaaagcaga | tgcccagttg | ccttccctac |
| 4981 | ctctgccaag | agctgcccgt | atgtgttttt | aagccctccc | cctttttta | agattaacta |
| 5041 | cttggaacag | ttgttctctt | aggtgtcctc | tttgctggag | agtagttgat | ttggtggtga |
| 5101 | ggtataaagt | aaggagacaa | tctaagttga | cccttccagc | ttgcctgtgt | gttgcacctc |
| 5161 | tctgtgcaac | tatctcaggt | atgtcttcac | agggcagcca | agggcctttc | cccatactgt |
| 5221 | ggcttaaggc | tttggtgtcc | tgatagatca | gacttattac | ttgtcatgct | tttgcctgag |
| 5281 | cactttgcta | aacccaggct | tccttgcacc | ttaccctccc | cagtcaatca | gctctatttt |
| 5341 | tttttctgaa | tgcattctgt | attcttccct | tagtgcgatg | catttccctg | caggcaagct |
| 5401 | agtattgttc | attcctggac | cgttgttgga | gtctttcaaa | tgactctgga | atttttgccc |
| 5461 | agttaaaatg | tccctgtgac | tgacaagtag | caaactcaac | attatttatc | atagtttaga |
| 5521 | tggtaacagc | atctccatca | cagtttgggg | acagtctaga | tcagcggtgt | gaccctttag |
| 5581 | tgcagttcct | catgttgtgg | tgacccccag | ccataaaatt | attttattgc | tacttcatta |
| 5641 | ctgtaatttt | gctactgtta | tgaatcataa | tgtaaatatc | tttgattttt | gatggtctta |
| 5701 | ggtgacccct | gtgaaaaggt | tgtttgacca | cccctccccc | aaggggttgc | aacccacagg |
| 5761 | ttgagaaacc | actgttgtaa | agtgtccgat | ttattccagt | gatggtggtc | tgtggtctgc |
| 5821 | agaggtagac | ctctgccatt | ggctcctctt | ctgttttcca | gcttgcttga | ttattttact |
| 5881 | tgttcagact | acctttgtc | cagggagatt | gagggacaag | ttatttcttg | gattatagtt |
| 5941 | tatgtgttta | aatacttgga | gccagaaaat | gctgagttaa | tctcatgagt | gcttttgcga |
| 6001 | taagaattgg | cctcatgtgt | tatatcttga | atagagactt | ttaccttggc | cattataggt |
| 6061 | agcttatata | catgagagtt | gcctcaaaca | ttttagtttt | agtgtatatg | tgtgtgtgtg |
| 6121 | ttcaagtgta | cacacatgta | ccctcagaaa | acaaacggtg | gggttatctt | aacaatgatg |
| 6181 | aaagatacat | tgtttaaatc | tcagatctca | gtaaagagat | cccatttgct | tgtagactca |
| 6241 | tgacacaatc | agtgtattta | aaatgaaatt | accagtcctt | atttgacagt | gcagctggta |
| 6301 | tgctggtgtt | cgggcactgg | tgaaaatcat | aagaaatcaa | ttaccgccaa | taaagctttc |
| 6361 | catatacctc | atccctaaac | tacacccagc | actgagggtt | aacttgaaaa | tctgtctctt |
| 6421 | cttcatttgg | gtctccccat | gaaattccag | agacccggga | agtacctcca | tgaagtcaga |
| 6481 | gtcccacacc | taatgctact | ctaaaggaag | gtagttcagg | cctgtcttgg | cagtgaacta |
| 6541 | ccaagaaatg | attttccaag | acttcttaga | acctctgtat | actaaccacc | tatgtgttca |
| 6601 | ttggctagct | tctgagtctt | agagtggacc | ccaggtttca | caaatgctag | agatgtagga |
| 6661 | tcccttggga | aaaggggtgt | tttttggttt | gctattttgg | gatggaaggt | aaggatttgt |
| 6721 | accttttttc | tgtcttgaag | taatttttaa | acaaccaaat | acgcaacata | agaacagata |

TABLE 1-continued 6781 caaagcttta gcgtgttgga aaacgctctg attagtgtac aacttccaaa ccagctgtta
6841 cccttcctct ctctggcttt aaggttcctg gctggttgca gtggtaaaca ctaagtaact
6901 ttatgtttct aaggctgtat taaattgtgc ccttcacagt gttgtgtcat agggggttgg
6961 ctttggggag ctgagaagaa acctgccttg aagggccagt gcctagctgg ttgcacattt
7021 gtccttgcct ctgtagggtg gtggattatt ggcttataga ggtagtttac agagactggt
7081 ttaaatcacg agaataacta accaacccct ggcctctgaa ccatgtatgt acatataccg
7141 atccagccta tttcttggta aaatgcagaa ttcaaattgg gcacacatta gaccagcttt
7201 accttcgact tcatttacgc ttttattgac tctgacataa ggtgtgagta tttgactttc
7261 tttgttggtg gcagtgatct gtaacactca gcactttcta ggtgagctaa accaagaaaa
7321 tccacagtga ctggctaagg ctgcaacttc attggaaggc aagtgaaaaa gcatcagagg
7381 cctcctgcct caaggctggc ctcctgggag ctcagtacac agtagtgtgg ctctgggcct
7441 ctgcaagggc cttcaagctt ggctgtcctc atacacgaaa ttagaatgtg ggagtagttg
7501 gcgttgaagg tcttcacatt taaagggata taaaacgata catgaaacta gaatattcat
7561 ttagctcaga aaatctcaac acgtggtagg taagatgcta tgtaacttac gggaacagga
7621 gactcgggac gtcttgtctg aaagtgggtt tcaagagtga agtctgatac actaccacta
7681 aatgtacttg gtctgagtta aataacctta aggtatttcc cagcttccag ctggttagcc
7741 tttagcaaga gagctacaag tgcattgtcc ttaaggagcc ttatgtacac agacgttctt
7801 ttctctgcac gtgtcaaggg aaggtgacca gtcccagcca tgcctgggac aagggtccca
7861 gatatgcaat gctaagtgcc aaccaaagtg agtcctaggg gtcctgggag gagttgtccc
7921 cttaggtgtc ctcaggactt attctcatac tgatgtcatc ctagctgata actgtgttgg
7981 gttatgccat ggctgtcaat atttttagga ctcaacccct gtattctgta ttcattactg
8041 tggatgcaac ctaagattta caataaataa cacaaagaac aatggagttg agtatggaat
8101 gaaaagaggc aacgagctag ggatgatctg tgtaggtgta agtacacttt gtgtccttag
8161 gagttcttgt aacagaaacc gtgtgaaact atagatgtct tctcctataa gggaaaacat
8221 ggtgtttgat gctttggtct ctatttccca gtctgtcctg cttaagaagc cagaatgtgg
8281 tttctatttg gtggatgctg tcttaaaatt actaaatgtg tcatccggaa gcaggtaaag
8341 gagtcagtat ccctgtggag ttctgtccta ctctcacggt gcttaccagc taagctgagc
8401 tcaggagcca agggaaaccc tgctcctgct ctctggtggt cctcagtggc tgatgcagtg
8461 cactgtgatg gagatactaa aacaagtgtg ttatttgtaa gtcttctctc agtgattgtc
8521 agacaactgt ggtgtgtgtg tgtgtgtgtg tgtgtgtgtg tgtgtgtgtg tgagaaacag
8581 tgagctgagg ctttattata gctgatttcc agttaaaatt gtgaaatacg tatttcttgt
8641 ccacaccaaa tatttcagtc tatttaatgt attaaagaaa tagttctgct taagaaaatg
8701 ttgcttaaat gttctgtgat ttctggtgca tttttataca gatctgtgtg tgtctgtgca
8761 ttcactttct gcctttgctc tctgtgttaa ctgtcctgtt gccctcggaa ggtggacact
8821 attcgtagca ttaaaaagaa atatttgagt tatttaccat gtc SEQ ID NO: 8 Mouse Smad2 Isoform 1 Amino Acid Sequence (NP_001239410.1)
1 mssilpftpp vvkrllgwkk saggsggagg geqngqeekw cekavkslvk klkktgrlde
61 lekaittqnc ntkavtipst cseiwglsta ntvdqwdttg lysfseqtrs ldgrlqvshr
121 kglphviycr lwrwpdlhsh helkaience yafnlkkdev cvnpyhyqrv etpvlppvlv
181 prhteiltel ppldydthsi pentnfpagi epqsnyipet pppgyisedg etsdqqlnqs
241 mdtgspaels pttlspvnhs ldlqpvtyse pafwcsiayy elnqrvgetf hasqpsltvd
301 gftdpsnser fclgllsnvn rnatvemtrr higrgvrlyy iggevfaecl sdsaifvqsp
361 ncnqrygwhp atvckippgc nlkifnnqef aallaqsvnq gfeavyqltr mctirmsfvk
421 gwgaeyrrqt vtstpcwiel hlngplqwld kvltqmgsps vrcssms SEQ ID NO: 9 Mouse Smad2 transcript variant 3 mRNA Sequence
(NM_001311070.1; CDS: 48-1361)
1 atttaccggg cttttctga gtgtggattg ttacctttgg taagaaaatg tcgtccatct
61 tgccattcac tccgccagtg gtgaagagac ttctgggatg gaaaaaatca gccggtgggt
121 ctggaggagc aggtggtgga gagcagaatg gacaggaaga aaagtggtgt gaaaaagcag
181 tgaaaagtct ggtgaaaaag ctaaagaaaa caggacggtt agatgagctt gagaaagcca
241 tcaccactca gaattgcaat actaaatgtg tcaccatacc aaggtctctt gatggccgtc
301 ttcaggtttc acaccggaaa gggttgccac atgttatata ttgccggctc tggcgctggc
361 cggaccttca cagtcatcat gagctcaagg caatcgaaaa ctgcgaatat gcttttaatc
421 tgaaaaaaga tgaagtgtgt gtaaatccgt accactacca gagagttgag accccagtct
481 tgcctccagt cttagtgcct cggcacacgg agattctaac agaactgccg cccctggatg
541 actacaccca ctccattcca gaaaacacaa atttcccagc aggaattgag ccacagagta
601 attacatccc agaaacacca ccacctggat atatcagtga agatggagaa acaagtgacc
661 aacagttgaa ccaaagtatg gacacaggct ctccggctga actgtctcct actactctct
721 ctcctgttaa tcacagcttg gatttgcagc cagttactta ctcggaacct gcattctggt
781 gttcaatcgc atactatgaa ctaaaccaga gggttggaga gaccttccat gcgtcacagc
841 cctcgctcac tgtagacggc ttcacagacc catcaaactc ggagaggttc tgcttaggct
901 tgctctccaa cgttaaccga aatgccactg tagaaatgac aagaagacat ataggaaggg
961 gagtgcgctt gtattacata ggtggggaag tgtttgctga gtgcctaagt gatagtgcaa
1021 tctttgtgca gagccccaac tgtaaccaga gatacggctg gcaccctgca acagtgtgta
1081 agatcccacc aggctgtaac ctgaagatct tcaacaacca agaatttgct gctcttctgg
1141 ctcagtctgt caaccagggt tttgaagccg tttatcagct aacccgaatg tgcaccataa
1201 gaatgagttt tgtgaagggc tggggagcag aatatcggag gcagacagta acaagtactc
1261 cttgctggat tgaacttcat ctgaatggcc ctctgcagtg gctggacaaa gtattaactc
1321 agatgggatc cccttcagtg cgatgctcaa gcatgtcgta aacccatcaa agactcgctg
1381 taacagctcc tccgtcgtag tattcatgta tgatcccgtg gactgtttgc tatccaaaaa
1441 ttccagagca aaaacagcac ttgaggtctc atcagttaaa gcaccttgtg gaatctgttt
1501 cctatatttg aatattagat gggaaaatta gtgtctagaa atgccctccc cagcggggaa
1561 aaagaagact taaagactta atgatgtctt gttgggcata agacagtatc ccaaaggtta
1621 ttaataacag tagtagttgt gtacaggtaa tgtgtccaga cccagtattg cagtactatg
1681 ctgtttgtat acattcttag tttgcataaa tgaggtgtgt gtgctgcttc ttggtctagg
1741 caagccttta taaaattaca gtatctaatc tgttattccc acttctccgt tatttttgtg
1801 tctttttaa tatataatat atatatatca agattttcaa attatcattt agaagcagat
1861 tttccttgta gaaactaatt tttctgcctt ttaccaaaaa taaacaaact cttgggggaa TABLE 1-continued

| | | | | | | |
|---|---|---|---|---|---|---|
| 1921 | gacaagtgga | ttaacttgga | agtccttgac | cttcatgtgt | ccagtggatc | ttagcagtcg |
| 1981 | ttcttttgtg | agccttttct | cctgagttgc | attagaagga | aaccttactg | gaaccgtcca |
| 2041 | ggctcctcat | cccattcctg | ttctggttca | gagcagtaca | gcagaatgac | gtcgtgctaa |
| 2101 | acagttgcac | tgctggcttc | tgggttagtt | gtttctgagt | ccaggaaagg | tttgtgtggg |
| 2161 | cagtaagtcc | ttttgtctaa | taaccagact | tcagcagatg | ataactgatg | tgtataacca |
| 2221 | gttgttctgt | tgattaactt | ttgtctcaaa | catgcacagg | tggcagtata | attattttca |
| 2281 | gggctattct | agaatcatct | cagtctgttt | ccttcttcca | aagccagtct | aataataaag |
| 2341 | tacctttctg | taaaggcagc | cgaccttttg | cctcatttta | cttttactac | caggttgtat |
| 2401 | tacagaacag | accttttgta | aatgtgttag | agtgacgctg | aggtcttgtc | agcagatagg |
| 2461 | gccatctgtt | tttaaagtgt | attgtatgta | atttataagt | agaatgttat | tttacctagc |
| 2521 | ttcaaaggtt | taaatattgt | gagctaagcc | atttagcaag | atttctagcc | cgcagttagc |
| 2581 | tgtggactta | gctcttcctg | acttaccctg | ggtgtgtggt | ttgctgacct | ttcagctctg |
| 2641 | caggaaggag | atcccagctg | tcctttggtc | ctcccttctg | cagcacacga | cagtcatgtc |
| 2701 | cagtgttgac | tcctttctcg | tttgcaactc | cgtacaaatg | cctggtctcc | tttttgtaaa |
| 2761 | ctttcatatt | tttgcagaca | aatacttttg | gtacttactc | tttgagacca | ttctcacatg |
| 2821 | tatgtacagt | aatcattttt | gatgcttttc | aacattggtt | gttttctatt | tgatatttct |
| 2881 | cattttccta | tatttgtgtt | tgtatgttat | gtgttcatgt | aaatttggta | tagtaatttt |
| 2941 | tattcaaata | tttattgttc | acctgttaat | gtgccatgaa | cttccttaac | ttttgggtga |
| 3001 | aggtgaacaa | gatagctata | gttcctgcct | ttgctaagag | cagttggttt | aacccatact |
| 3061 | caagtgtctg | cataggaggt | aaacagggta | tactttgaga | atggcagaga | cgatgctttt |
| 3121 | ggtaggatat | taggaaggca | tctggagagt | gatgtgtaag | ctaaccccctg | acctaggaag |
| 3181 | agaaagccat | gtgaagagcc | aagggcaatt | taacactgct | ggaacattat | cagcatccaa |
| 3241 | aggctcaggc | tcatagagac | tcactgtcag | gtatcatgat | tgtgcacaca | cctgcacaca |
| 3301 | cccacacgtg | gtgatgaaaa | tgcttgttca | gtttagaatt | tgttgaaggt | gggactgctt |
| 3361 | tgtgacaggc | tgcttctgtc | atctcactgt | aatctattcc | tcagaccttg | tacagctttc |
| 3421 | ttacaccagg | tcagtgccac | ttaatttaac | aactcccgtt | acgtaaatgc | tcaccagtct |
| 3481 | ggagcctccc | tgcttgcttc | tggacgtgtt | gctgcatatc | ggctatcact | gcttcccttc |
| 3541 | cgctgcccat | cttgtgatag | agcaattgtc | ctgtgcatta | ttgctgttga | gcctactgga |
| 3601 | gatccttgta | cataaactgc | cccttctctg | gaagtttcca | cagactagaa | aacttgagct |
| 3661 | gttgggacag | ttctggggca | gaggacagct | ttgaaagtgg | taggaggtta | tcagacatgt |
| 3721 | taaagtgttg | ccaacagtga | gacacagctc | catggttggg | gttcaggaat | aggttttcta |
| 3781 | taccaccgag | cgtgaacaag | tcaccgtgta | aactcatgtg | aaaagaattc | agtgcttatc |
| 3841 | tttgcttttc | accggaatgc | tgtgggcatg | cgctactgtc | acctagattt | tgttgatttc |
| 3901 | acctcttttg | caagactgat | ttttgttcca | gatgattcct | acggcctctc | ttggttgatt |
| 3961 | tatattgatt | taatttctcc | acattattta | gcatcatgtc | tcagcagtaa | tttgaaagcc |
| 4021 | tttctaccag | attcaaacat | ttggttgtat | taggccagtc | ttttggaatg | ccactaaact |
| 4081 | gggctgtgac | ttaaggaccc | tttcctgcta | gggtctgagc | cacaccagtt | agacttacta |
| 4141 | tccatcgtta | tatacattta | gtcagcatag | ttcctgccta | ttgtttaccc | agccaatgtg |
| 4201 | attctgggac | catgtcctgg | ctctggagtt | gggcttagtc | ctgtgagagt | tcctgttgtt |
| 4261 | ttcagggcct | atgactttgc | cagaaggaat | ttgcatatgt | tttcttgaga | gctgaatctt |
| 4321 | ctaattgtgt | acatatatgt | atgtatatgt | acagagttcc | ttctttgttt | ctttaatttc |
| 4381 | accttcatca | cgccttggtt | gtcagttcat | cccgactaag | agtccaagtc | agtcaggtta |
| 4441 | gtaggctttt | gctggttgaa | gtcaaagaaa | gcagatgccc | agttgccttc | cctacctctg |
| 4501 | ccaagagctg | cccgtatgtg | tttttaagcc | ctcccccttt | ttttaagatt | aactacttgg |
| 4561 | aacagttgtt | ctcttaggtg | tcctctttgc | tggagagtag | ttgatttggt | ggtgaggtat |
| 4621 | aaagtaagga | gacaatctaa | gttgaccctt | ccagcttgcc | tgtgtgttgc | acctctctgt |
| 4681 | gcaactatct | caggtatgtc | ttcacagggc | agccaagggc | ctttccccat | actgtggctt |
| 4741 | aaggctttgg | tgtcctgata | gatcagactt | attacttgtc | atgcttttgc | ctgagcactt |
| 4801 | tgctaaaccc | aggcttcctt | gcaccttacc | ctccccagtc | aatcagctct | attttttttt |
| 4861 | ctgaatgcat | tctgtattct | tcccttagtg | cgatgcattt | ccctgcaggc | aagctagtat |
| 4921 | tgttcattcc | tggaccgttg | ttggagtctt | tcaaatgact | ctggaatttt | tgcccagtta |
| 4981 | aaatgtccct | gtgactgaca | agtagcaaac | tcaacattat | ttatcatagt | ttagatggta |
| 5041 | acagcatctc | catcacagtt | tggggacagt | ctagatcagc | ggtgtgaccc | tttagtgcag |
| 5101 | ttcctcatgt | tgtggtgacc | cccagccata | aaattatttt | attgctactt | cattactgta |
| 5161 | attttgctac | tgttatgaat | cataatgtaa | atatctttga | tttttgatgg | tcttaggtga |
| 5221 | cccctgtgaa | aaggttgttt | gaccacccct | cccccaaggg | gttgcaaccc | acaggttgag |
| 5281 | aaaccactgt | tgtaaagtgt | ccgatttatt | ccagtgatgg | tggtctgtgg | tctgcagagg |
| 5341 | tagacctctg | ccattggctc | ctcttctgtt | ttccagcttg | cttgattatt | ttacttgttc |
| 5401 | agactacctt | ttgtccaggg | agattgaggg | acaagttatt | tcttggatta | tagtttatgt |
| 5461 | gtttaaatac | ttggagccag | aaaatgctga | gttaatctca | tgagtgcttt | tgcgataaga |
| 5521 | attggcctca | tgtgttatat | cttgaataga | gacttttacc | ttggccatta | taggtagctt |
| 5581 | atatacatga | gagttgcctc | aaacatttta | gttttagtgt | atatgtgtgt | gtgtgttcaa |
| 5641 | gtgtacacac | atgtaccctc | agaaaacaaa | cggtggggtt | atcttaacaa | tgatgaaaga |
| 5701 | tacattgttt | aaatctcaga | tctcagtaaa | gagatcccat | ttgcttgtag | actcatgaca |
| 5761 | caatcagtgt | atttaaaatg | aaattaccag | tccttatttg | acagtgcagc | tggtatgctg |
| 5821 | gtgttcgggc | actggtgaaa | atcataagaa | atcaattacc | gccaataaag | ctttccatat |
| 5881 | acctcatccc | taaactacac | ccagcactga | gggttaactt | gaaaatctgt | ctcttcttca |
| 5941 | tttgggtctc | cccatgaaat | tccagagacc | cgggaagtac | ctccatgaag | tcagagtccc |
| 6001 | acacctaatg | ctactctaaa | ggaaggtagt | tcaggcctgt | cttggcagtg | aactaccaag |
| 6061 | aaatgatttt | ccaagacttc | ttagaacctc | tgtatactaa | ccacctatgt | gttcattggc |
| 6121 | tagcttctga | gtcttagagt | ggaccccagg | tttcacaaat | gctagagatg | taggatccct |
| 6181 | tgggaaaagg | ggtgtttttt | ggtttgctat | tttgggatgg | aaggtaagga | tttgtacctt |
| 6241 | ttttctgtct | tgaagtaatt | tttaaacaac | caaatacgca | acataagaac | agatacaaag |
| 6301 | ctttagcgtg | ttggaaaacg | ctctgattag | tgtacaactt | ccaaaccagc | tgttaccctt |
| 6361 | cctctctctg | gctttaaggt | tcctggctgg | ttgcagtggt | aaacactaag | taactttatg |
| 6421 | tttctaaggc | tgtattaaat | tgtgcccttc | acagtgttgt | gtcatagggg | gttggctttg |
| 6481 | gggagctgag | aagaaacctg | ccttgaaggg | ccagtgccta | gctggttgca | catttgtcct |
| 6541 | tgcctctgta | gggtggtgga | ttattggctt | atagaggtag | tttacagaga | ctggtttaaa |
| 6601 | tcacgagaat | aactaaccaa | cccctggcct | ctgaaccatg | tatgtacata | taccgatcca |
| 6661 | gcctatttct | tggtaaaatg | cagaattcaa | attgggcaca | cattagacca | gctttacctt |

TABLE 1-continued

```
6721 cgacttcatt tacgctttta ttgactctga cataaggtgt gagtatttga ctttctttgt
6781 tggtggcagt gatctgtaac actcagcact ttctaggtga gctaaaccaa gaaaatccac
6841 agtgactggc taaggctgca acttcattgg aaggcaagtg aaaaagcatc agaggcctcc
6901 tgcctcaagg ctggcctcct gggagctcag tacacagtag tgtggctctg ggcctctgca
6961 agggccttca agcttggctg tcctcataca cgaaattaga atgtgggagt agttggcgtt
7021 gaaggtcttc acatttaaag ggatataaaa cgatacatga aactagaata ttcatttagc
7081 tcagaaaatc tcaacacgtg gtaggtaaga tgctatgtaa cttacgggaa caggagactc
7141 gggacgtctt gtctgaaagt gggtttcaag agtgaagtct gatacactac cactaaatgt
7201 acttggtctg agttaaataa ccttaaggta tttcccagct tccagctggt tagcctttag
7261 caagagagct acaagtgcat tgtccttaag gagccttatg tacacagacg ttcttttctc
7321 tgcacgtgtc aagggaaggt gaccagtccc agccatgcct gggacaaggg tcccagatat
7381 gcaatgctaa gtgccaacca aagtgagtcc taggggtcct gggaggagtt gtccccttag
7441 gtgtcctcag gacttattct catactgatg tcatcctagc tgataactgt gttgggttat
7501 gccatggctg tcaatatttt taggactcaa cccctgtatt ctgtattcat tactgtggat
7561 gcaacctaag atttacaata aataacacaa agaacaatgg agttgagtat ggaatgaaaa
7621 gaggcaacga gctagggatg atctgtgtag gtgtaagtac actttgtgtc cttaggagtt
7681 cttgtaacag aaaccgtgtg aaactataga tgtcttctcc tataagggaa aacatggtgt
7741 ttgatgcttt ggtctctatt tcccagtctg tcctgcttaa gaagccagaa tgtggtttct
7801 atttggtgga tgctgtctta aaattactaa atgtgtcatc cggaagcagg taaaggagtc
7861 agtatccctg tggagttctg tcctactctc acggtgctta ccagctaagc tgagctcagg
7921 agccaaggga aaccctgctc ctgctctctg gtggtcctca gtggctgatg cagtgcactg
7981 tgatggagat actaaaacaa gtgtgttatt tgtaagtctt ctctcagtga ttgtcagaca
8041 actgtggtgt gtgtgtgtgt gtgtgtgtgt gtgtgtgtgt gtgtgtgaga aacagtgagc
8101 tgaggcttta ttatagctga tttccagtta aaattgtgaa atacgtattt cttgtccaca
8161 ccaaatattt cagtctattt aatgtattaa agaaatagtt ctgcttaaga aaatgttgct
8221 taaatgttct gtgatttctg gtgcattttt atacagatct gtgtgtgtct gtgcattcac
8281 tttctgcctt tgctctctgt gttaactgtc ctgttgccct cggaaggtgg acactattcg
8341 tagcattaaa aagaaatatt tgagttattt accatgtc
```

SEQ ID NO: 10 Mouse Smad2 Isoform 2 Amino Acid Sequence (NP_001297999.1)

```
  1 mssilpftpp vvkrllgwkk saggsggagg geqngqeekw cekavkslvk klkktgrlde
 61 lekaittqnc ntkcvtiprs ldgrlqvshr kglphviycr lwrwpdlhsh helkaience
121 yafnlkkdev cvnpyhyqrv etpvlppvlv prhteiltel pplddythsi pentnfpagi
181 epqsnyipet pppgyisedg etsdqqlnqs mdtgspaels pttlspvnhs ldlqpvtyse
241 pafwcsiayy elnqrvgetf hasqpsltvd gftdpsnser fclgllsnvn rnatvemtrr
301 higrgvrlyy iggevfaecl sdsaifvqsp ncnqrygwhp atvckippgc nlkifnnqef
361 aallaqsvnq gfeavyqltr mctirmsfvk gwgaeyrrqt vtstpcwiel hlngplqwld
421 kvltqmgsps vrcssms
```

SEQ ID NO: 11 Mouse Smad2 transcript variant 1 Sequence (NM_010754.5; CDS: 332-1735)

```
   1 cgccccgctc ggcccccggc cctgcccgcg gcgcccggcc tccttccgtc cctgccgtgc
  61 tccctccgtc ttccgtgcgc gcccgctcgg ccggcgtgcc tcacgcctaa cgggcggccg
 121 cgggcgccaa tcagcgggcg gcagggtgcc agcccggggc tgcgccggcg aatcggcggg
 181 gtccgcggct cggggaggga ggcggggcta ccgcgcgcgg cggtggagga gcagctcgcc
 241 aagcctgcag ctcgcgagcg ccgagcgagc ctcccggagg gtagatttac cgggcttttt
 301 ctgagtgtgg attgttacct ttggtaagaa aatgtcgtcc atcttgccat tcactccgcc
 361 agtggtgaag agacttctgg gatggaaaaa atcagccggt gggtctggag gagcaggtgg
 421 tggagagcag aatggacagg aagaaaagtg gtgtgaaaaa gcagtgaaaa gtctggtgaa
 481 aaagctaaag aaaacaggac ggttagatga gcttgagaaa gccatcacca ctcagaattg
 541 caatactaaa tgtgtcacca taccaagcac ttgctctgaa atttggggac tgagtacagc
 601 aaatacggta gatcagtggg acacaacagg cctttacagc ttctctgaac aaaccaggtc
 661 tcttgatggc cgtcttcagg tttcacaccg gaaagggttg ccacatgtta tatattgccg
 721 gctctggcgc tggccggacc ttcacagtca tcatgagctc aaggcaatcg aaaactgcga
 781 atatgctttt aatctgaaaa aagatgaagt gtgtgtaaat ccgtaccact accagagagt
 841 tgagaccccca gtcttgcctc cagtcttagt gcctcggcac acggagattc taacagaact
 901 gccgccccctg gatgactaca cccactccat tccagaaaac acaaatttcc cagcaggaat
 961 tgagccacag agtaattaca tcccagaaac accaccacct ggatatatca gtgaagatgg
1021 agaaacaagt gaccaacagt tgaaccaaag tatggacaca ggctctccgg ctgaactgtc
1081 tcctactact ctctctcctg ttaatcacag cttggatttg cagccagtta cttactcgga
1141 acctgcattc tggtgttcaa tcgcatacta tgaactaaac cagagggttg gagagacctt
1201 ccatgcgtca cagccctcgc tcactgtaga cggcttcaca gacccatcaa actcggagag
1261 gttctgctta ggcttgctct ccaacgttaa ccgaaatgcc actgtagaaa tgacaagaag
1321 acatatagga aggggagtgc gcttgtatta cataggtggg gaagtgtttg ctgagtgcct
1381 aagtgatagt gcaatctttg tgcagagccc caactgtaac cagagatacg gctggcaccc
1441 tgcaacagtg tgtaagatcc caccaggctg taacctgaag atcttcaaca accaagaatt
1501 tgctgctctt ctggctcagt ctgtcaacca gggttttgaa gccgtttatc agctaacccg
1561 aatgtgcacc ataagaatga gttttgtgaa gggctgggga gcagaatatc ggaggcagac
1621 agtaacaagt actccttgct ggattgaact tcatctgaat ggccctctgc agtggctgga
1681 caaagtatta actcagatgg gatccccttc agtgcgatgc tcaagcatgt cgtaaaccca
1741 tcaaagactc gctgtaacag ctcctccgtc gtagtattca tgtatgatcc cgtggactgt
1801 ttgctatcca aaaattccag agcaaaaaca gcacttgagg tctcatcagt taaagcacct
1861 tgtggaatct gtttcctata tttgaatatt agatgggaaa attagtgtct agaaatgccc
1921 tccccagcgg ggaaaaagaa gacttaaaga cttaatgatg tcttgttggg cataagacag
1981 tatcccaaag gttattaata acagtagtag ttgtgtacag gtaatgtgtc cagacccagt
2041 attgcagtac tatgctgttt gtatacattc ttagtttgca taaatgaggt gtgtgtgctg
2101 cttcttggtc taggcaagcc tttataaaat tacagtatct aatctgttat tcccacttct
2161 ccgttatttt tgtgtctttt ttaatatata atatatatat atcaagattt tcaaattatc
2221 atttagaagc agattttcct tgtagaaact aatttttctg ccttttacca aaaataaaca
2281 aactcttggg ggaagacaag tggattaact tggaagtcct tgaccttcat gtgtccagtg
```

TABLE 1-continued 2341 gatcttagca gtcgttcttt tgtgagcctt ttctcctgag ttgcattaga aggaaacctt
2401 actggaaccg tccaggctcc tcatcccatt cctgttctgg ttcagagcag tacagcagaa
2461 tgacgtcgtg ctaaacagtt gcactgctgg cttctgggtt agttgtttct gagtccagga
2521 aaggtttgtg tgggcagtaa gtcctttttgt ctaataacca gacttcagca gatgataact
2581 gatgtgtata accagttgtt ctgttgatta acttttgtct caaacatgca caggtggcag
2641 tataattatt ttcagggcta ttctagaatc atctcagtct gtttccttct tccaaagcca
2701 gtctaataat aaagtacctt tctgtaaagg cagccgacct tttgcctcat tttactttta
2761 ctaccaggtt gtattacaga acagaccttt tgtaaatgtg ttagagtgac gctgaggtct
2821 tgtcagcaga tagggccatc tgtttttaaa gtgtattgta tgtaatttat aagtagaatg
2881 ttattttacc tagcttcaaa ggtttaaata ttgtgagcta agccatttag caagatttct
2941 agcccgcagt tagctgtgga cttagctctt cctgacttac cctgggtgtg tggtttgctg
3001 acctttcagc tctgcaggaa ggagatccca gctgtccttt ggtcctccct tctgcagcac
3061 acgacagtca tgtccagtgt tgactccttt ctcgtttgca actccgtaca aatgcctggt
3121 ctcctttttg taaactttca tatttttgca gacaaatact tttggtactt actctttgag
3181 accattctca catgtatgta cagtaatcat ttttgatgct tttcaacatt ggttgttttc
3241 tatttgatat ttctcatttt cctatatttg tgtttgtatg ttatgtgttc atgtaaattt
3301 ggtatagtaa tttttattca aatatttatt gttcacctgt taatgtgcca tgaacttcct
3361 taacttttgg gtgaaggtga acaagatagc tatagttcct gcctttgcta agagcagttg
3421 gtttaaccca tactcaagtg tctgcatagg aggtaaacag ggtatacttt gagaatggca
3481 gagacgatgc ttttggtagg atattaggaa ggcatctgga gagtgatgtg taagctaacc
3541 cctgacctag gaagagaaag ccatgtgaag agccaagggc aatttaacac tgctggaaca
3601 ttatcagcat ccaaaggctc aggctcatag agactcactg tcaggtatca tgattgtgca
3661 cacacctgca cacacccaca cgtggtgatg aaaatgcttg ttcagtttag aatttgttga
3721 aggtgggact gctttgtgac aggctgcttc tgtcatctca ctgtaatcta ttcctcagac
3781 cttgtacagc tttcttacac caggtcagtg ccacttaatt taacaactcc cgttacgtaa
3841 atgctcacca gtctggagcc tccctgcttg cttctggacg tgttgctgca tatcggctat
3901 cactgcttcc cttccgctgc ccatcttgtg atagagcaat tgtcctgtgc attattgctg
3961 ttgagcctac tggagatcct tgtacataaa ctgccccttc tctggaagtt tccacagact
4021 agaaaacttg agctgttggg acagttctgg ggcagaggac agctttgaaa gtggtaggag
4081 gttatcagac atgttaaagt gttgccaaca gtgagacaca gctccatggt tggggttcag
4141 gaataggttt tctataccac cgagcgtgaa caagtcaccg tgtaaactca tgtgaaaaga
4201 attcagtgct tatctttgct tttcaccgga atgctgtggg catgcgctac tgtcacctag
4261 attttgttga tttcacctct tttgcaagac tgatttttgt tccagatgat tcctacggcc
4321 tctcttggtt gatttatatt gatttaattt ctccacatta tttagcatca tgtctcagca
4381 gtaatttgaa agcctttcta ccagattcaa acatttggtt gtattaggcc agtcttttgg
4441 aatgccacta aactgggctg tgacttaagg accctttcct gctagggtct gagccacacc
4501 agttagactt actatccatc gttatataca tttagtcagc atagttcctg cctattgttt
4561 acccagccaa tgtgattctg ggaccatgtc ctggctctgg agttgggctt agtcctgtga
4621 gagttcctgt tgttttcagg gcctatgact ttgccagaag gaatttgcat atgttttctt
4681 gagagctgaa tcttctaatt gtgtacatat atgtatgtat atgtacagag ttccttcttt
4741 gtttctttaa tttcaccttc atcacgcctt ggttgtcagt tcatcccgac taagagtcca
4801 agtcagtcag gttagtaggc ttttgctggt tgaagtcaaa gaaagcagat gcccagttgc
4861 cttccctacc tctgccaaga gctgcccgta tgtgttttta agccctcccc cttttttttaa
4921 gattaactac ttggaacagt tgttctctta ggtgtcctct ttgctggaga gtagttgatt
4981 tggtggtgag gtataaagta aggagacaat ctaagttgac ccttccagct tgcctgtgtg
5041 ttgcacctct ctgtgcaact atctcaggta tgtcttcaca gggcagccaa gggcctttcc
5101 ccatactgtg gcttaaggct ttggtgtcct gatagatcag acttattact tgtcatgctt
5161 ttgcctgagc actttgctaa acccaggctt ccttgcacct taccctcccc agtcaatcag
5221 ctctattttt ttttctgaat gcattctgta ttcttccctt agtgcgatgc atttccctgc
5281 aggcaagcta gtattgttca ttcctggacc gttgttggag tctttcaaat gactctggaa
5341 tttttgccca gttaaaatgt ccctgtgact gacaagtagc aaactcaaca ttatttatca
5401 tagtttagat ggtaacagca tctccatcac agtttgggga cagtctagat cagcggtgtg
5461 accctttagt gcagttcctc atgttgtggt gacccccagc cataaaatta ttttattgct
5521 acttcattac tgtaattttg ctactgttat gaatcataat gtaaatatct ttgatttttg
5581 atggtcttag gtgaccccctg tgaaaaggtt gtttgaccac ccctcccccca aggggttgca
5641 acccacaggt tgagaaacca ctgttgtaaa gtgtccgatt tattccagtg atggtggtct
5701 gtggtctgca gaggtagacc tctgccattg gctcctcttc tgttttccag cttgcttgat
5761 tattttactt gttcagacta ccttttgtcc agggagattg agggacaagt tatttcttgg
5821 attatagttt atgtgtttaa atacttggag ccagaaaatg ctgagttaat ctcatgagtg
5881 cttttgcgat aagaattggc ctcatgtgtt atatcttgaa tagagacttt taccttggcc
5941 attataggta gcttatatac atgagagttg cctcaaacat tttagtttta gtgtatatgt
6001 gtgtgtgtgt tcaagtgtac acacatgtac cctcagaaaa caaacggtgg ggttatctta
6061 acaatgatga aagatacatt gtttaaatct cagatctcag taaagagatc ccatttgctt
6121 gtagactcat gacacaatca gtgtatttaa aatgaaatta ccagtcctta tttgacagtg
6181 cagctggtat gctggtgttc gggcactggt gaaaatcata agaaatcaat taccgccaat
6241 aaagctttcc atatacctca tccctaaact acacccagca ctgagggtta acttgaaaat
6301 ctgtctcttc ttcatttggg tctccccatg aaattccaga gacccgggaa gtacctccat
6361 gaagtcagag tcccacacct aatgctactc taaaggaagg tagttcaggc ctgtcttggc
6421 agtgaactac caagaaatga ttttccaaga cttcttagaa cctctgtata ctaaccacct
6481 atgtgttcat tggctagctt ctgagtctta gagtggaccc caggtttcac aaatgctaga
6541 gatgtaggat cccttgggaa aaggggtgtt ttttggtttg ctattttggg atggaaggta
6601 aggatttgta cctttttttct gtcttgaagt aatttttaaa caaccaaata cgcaacataa
6661 gaacagatac aaagctttag cgtgttggaa aacgctctga ttagtgtaca acttccaaac
6721 cagctgttac ccttcctctc tctggcttta aggttcctgg ctggttgcag tggtaaacac
6781 taagtaactt tatgtttcta aggctgtatt aaattgtgcc cttcacagtg ttgtgtcata
6841 gggggttggc tttggggagc tgagaagaaa cctgccttga agggccagtg cctagctggt
6901 tgcacatttg tccttgcctc tgtagggtgg tggattattg gcttatagag gtagtttaca
6961 gagactggtt taaatcacga gaataactaa ccaacccctg gcctctgaac catgtatgta
7021 catataccga tccagcctat ttcttggtaa aatgcagaat tcaaattggg cacacattag
7081 accagcttta ccttcgactt catttacgct tttattgact ctgacataag gtgtgagtat TABLE 1-continued

```
7141 ttgactttct ttgttggtgg cagtgatctg taacactcag cactttctag gtgagctaaa
7201 ccaagaaaat ccacagtgac tggctaaggc tgcaacttca ttggaaggca agtgaaaaag
7261 catcagaggc ctcctgcctc aaggctggcc tcctgggagc tcagtacaca gtagtgtggc
7321 tctgggcctc tgcaagggcc ttcaagcttg gctgtcctca tacacgaaat tagaatgtgg
7381 gagtagttgg cgttgaaggt cttcacattt aaagggatat aaaacgatac atgaaactag
7441 aatattcatt tagctcagaa aatctcaaca cgtggtaggt aagatgctat gtaacttacg
7501 ggaacaggag actcgggacg tcttgtctga aagtgggttt caagagtgaa gtctgataca
7561 ctaccactaa atgtacttgg tctgagttaa ataaccttaa ggtatttccc agcttccagc
7621 tggttagcct ttagcaagag agctacaagt gcattgtcct taaggagcct tatgtacaca
7681 gacgttcttt tctctgcacg tgtcaaggga aggtgaccag tcccagccat gcctgggaca
7741 agggtcccag atatgcaatg ctaagtgcca accaaagtga gtcctagggg tcctgggagg
7801 agttgtcccc ttaggtgtcc tcaggactta ttctcatact gatgtcatcc tagctgataa
7861 ctgtgttggg ttatgccatg gctgtcaata tttttaggac tcaacccctg tattctgtat
7921 tcattactgt ggatgcaacc taagatttac aataaataac acaaagaaca atggagttga
7981 gtatggaatg aaaagaggca acgagctagg gatgatctgt gtaggtgtaa gtacactttg
8041 tgtccttagg agttcttgta acagaaaccg tgtgaaacta tagatgtctt ctcctataag
8101 ggaaaacatg gtgtttgatg ctttggtctc tatttcccag tctgtcctgc ttaagaagcc
8161 agaatgtggt ttctatttgg tggatgctgt cttaaaatta ctaaatgtgt catccggaag
8221 caggtaaagg agtcagtatc cctgtggagt tctgtcctac tctcacggtg cttaccagct
8281 aagctgagct caggagccaa gggaaaccct gctcctgctc tctggtggtc ctcagtggct
8341 gatgcagtgc actgtgatgg agatactaaa acaagtgtgt tatttgtaag tcttctctca
8401 gtgattgtca gacaactgtg gtgtgtgtgt gtgtgtgtgt gtgtgtgtgt gtgtgtgtgt
8461 gagaaacagt gagctgaggc tttattatag ctgatttcca gttaaaattg tgaaatacgt
8521 atttcttgtc cacaccaaat atttcagtct atttaatgta ttaaagaaat agttctgctt
8581 aagaaaatgt tgcttaaatg ttctgtgatt tctggtgcat ttttatacag atctgtgtgt
8641 gtctgtgcat tcactttctg cctttgctct ctgtgttaac tgtcctgttg ccctcggaag
8701 gtggacacta ttcgtagcat taaaaagaaa tatttgagtt atttaccatg tc
```

SEQ ID NO: 12 Mouse Smad2 Isoform 1 Amino Acid Sequence (NP_034884.2)

```
  1 mssilpftpp vvkrllgwkk saggsggagg geqngqeekw cekavkslvk klkktgrlde
 61 lekaittqnc ntkcvtipst cseiwglsta ntvdqwdttg lysfseqtrs ldgrlqvshr
121 kglphviycr lwrwpdlhsh helkaience yafnlkkdev cvnpyhyqrv etpvlppvlv
181 prhteiltel pplddythsi pentnfpagi epqsnyipet pppgyisedg etsdqqlnqs
241 mdtgspaels pttlspvnhs ldlqpvtyse pafwcsiayy elnqrvgetf hasqpsltvd
301 gftdpsnser fclgllsnvn rnatvemtrr higrgvrlyy iggevfaecl sdsaifvqsp
361 ncnqrygwhp atvckippgc nlkifnnqef aallaqsvnq gfeavyqltr mctirmsfvk
421 gwgaeyrrqt vtstpcwiel hlngplqwld kvltqmgsps vrcssms
```

SEQ ID NO: 13 Rat Smad2 transcript variant 2 Sequence (NM_001277450.1; CDS: 210-1613)

```
   1 gggcgccaat cagcgggcgg cagggtgcca gcccggggct gcgccggcga atcggcgggg
  61 cccgcggctc ggggagggag gcggggctac cgcgcgcggc ggtggaggag cagctcgctc
 121 gcctgcagct cgcgagcgct gagcgagccg cccgaagggt agatttacca ggctgtttct
 181 gagtgtggat tgttaccctt ggtaagaaaa tgtcgtccat cttgccattc actccgccag
 241 tggtgaagag acttctggga tggaaaaaat cagccggtgg gtctggagga gcaggtggtg
 301 gagaacagaa tggacaggaa gaaaagtggt gtgaaaaagc agtgaaaagt ctggtgaaaa
 361 agctaaagaa aacaggacga ttagatgagc ttgagaaagc catcaccact cagaattgca
 421 atactaagtg tgtcaccata ccaagcactt gctctgaaat ttggggactg agtacagcaa
 481 atacggtaga tcagtgggac acaacaggcc tttacagctt ctctgaacaa accaggtctc
 541 ttgatggtcg tcttcaggtg tctcatcgga aagggctgcc acatgttata tattgccggc
 601 tgtggcgctg gccagacctt cacagccatc atgagctcaa ggcgatcgag aactgcgaat
 661 acgctttcag tctgaaaaaa gatgaagtgt gtgtgaaccc ttaccactac cagagggtgg
 721 agacaccagt cttgcctcca gtcttggtgc ctcggcacac agagattcta acagaactgc
 781 cgcctctgga tgactatacc cactccattc cagaaaacac aaatttccca gcaggaattg
 841 agccacagag taattacatc ccagaaacac caccacctgg atatatcagt gaagatggag
 901 aaactagtga ccaacagttg aaccaaagta tggacacagg ctctccggct gaactgtctc
 961 ctaccactct ctcccctgtc aatcacagct tggatttgca gccagttact tattcagaac
1021 ctgcattttg gtgttcaatc gcatattatg aactaaacca gagggttgga gagaccttcc
1081 atgcgtcaca gccctcactc actgtagacg gctttacaga tccatcgaac tcggagaggt
1141 tctgcttagg tttgctctcc aacgttaaca gaaacgctac tgtagaaatg accagaaggc
1201 atataggaag gggagtgcgc ttgtattaca taggtgggga agtgtttgcc gagtgcctaa
1261 gtgatagtgc gatctttgtg cagagcccca actgtaacca gagatacggc tggcaccccg
1321 cgacagtgtg caaaatccca ccaggctgta acctgaagat cttcaacaac caagaatttg
1381 ctgctcttct ggctcagtct gttaaccagg gttttgaggc cgtttatcag ctgactcgaa
1441 tgtgcaccat aagaatgagc ttcgtgaagg ggtggggagc agaataccgg aggcagacag
1501 taacaagtac tccttgctgg attgaacttc atctgaatgg ccccctgcag tggttggaca
1561 aagtattaac tcagatggga tccccgtcag tgcgatgctc aagcatgtcc taaagtccgt
1621 cagcagtgga gctcattgga agacttaacg taccaactcc tccgccacag tactcgtgtg
1681 tgatcccgtg gactgtgcta gtcaaaaccc agagcgaaaa cagcacttga ggtctcatca
1741 gttaaagcac cttgtggagt ctgtttccta catttgaatt ttagatggga aattagtgtc
1801 tagaaatgcc ctccccagag gggacaaaga agacttaaag acttaatgat gtctcgttgg
1861 gcataagaca gtgtcccaaa ggttattaat accagtagta gttgtgtaca gtaatgtgtc
1921 cagacccagt attgcagtgc tctgctgttt gtataccttc ttagtgtgca taaatgaggt
1981 gtgtgctgct gcttggtcta ggcaagcctt tataaaatta cagtacctaa tctgttattc
2041 ccacttctcc gttatttttg tgtctttttt aatatataat atatatatcg agattttcaa
2101 attatcattt agaagcagat tttccttgta gaaactaatt tttctgcctt ttaccaaaaa
2161 taaactcgtg ggggaagaaa agtggattaa cttggaagtc cttgacctta atgtgtccag
2221 tgggtcttag cattctttct gtgatcattt tctgctgaat tgcattagaa ggaaaccttg
2281 ttggaaactt ccaggctctt tgtgccattt ctgttctgat tcaaagcagt gcagcatgat
2341 gtcattgtgg taaatagttg cactgatggc ttctgggtta gttacttctg agtccagtaa
```

TABLE 1-continued

```
2401 aggattgtgt gagcagtaag tccttttgtc ttctaaccag acttcagcag atgataacca
2461 gttgttccat tgattaactt ttgtctcaaa cgtgcacagg tgacagtata attattttca
2521 gggctattct agaatcatct cagtatgttt ccttcttcca acgccagtct gataataaag
2581 tatctttctg taaaggca
```

SEQ ID NO: 14 Rat Smad2 Amino Acid Sequence (NP_001264379.1)

```
  1 mssilpftpp vvkrllgwkk saggsggagg geqngqeekw cekavkslvk klkktgrlde
 61 lekaittqnc ntkcvtipst cseiwglsta ntvdqwdttg lysfseqtrs ldgrlqvshr
121 kglphviycr lwrwpdlhsh helkaience yafslkkdev cvnpyhyqrv etpvlppvlv
181 prhteiltel pplddythsi pentnfpagi epqsnyipet pppgyisedg etsdqqlnqs
241 mdtgspaels pttlspvnhs ldlqpvtyse pafwcsiayy elnqrvgetf hasqpsltvd
301 gftdpsnser fclgllsnvn rnatvemtrr higrgvrlyy iggevfaecl sdsaifvqsp
361 ncnqrygwhp atvckippgc nlkifnnqef aallaqsvnq gfeavyqltr mctirmsfvk
421 gwgaeyrrqt vtstpcwiel hlngplqwld kvltqmgsps vrcssms
```

SEQ ID NO: 15 Rat Smad2 transcript variant 1 Sequence (NM_019191.2; CDS: 238-1641)

```
   1 tggagcaggc ggctccctcc ccagccggcc gcggtgagcg cgggcctggg ggcggggcgg
  61 gggcccgcgg cgcagttccg cctgcgcgcg cccactcctc cggcagcgcg gagcccgtcg
 121 gaagaggaag gaacaaaagg tccggggccc ggctcggacg ggccgggacc aggcgctggg
 181 tgcagggtag atttaccagg ctgtttctga gtgtggattg ttacccttgg taagaaaatg
 241 tcgtccatct tgccattcac tccgccagtg gtgaagagac ttctgggatg gaaaaaatca
 301 gccggtgggt ctggaggagc aggtggtgga gaacagaatg gacaggaaga aaagtggtgt
 361 gaaaaagcag tgaaaagtct ggtgaaaaag ctaaagaaaa caggacgatt agatgagctt
 421 gagaaagcca tcaccactca gaattgcaat actaagtgtg tcaccatacc aagcacttgc
 481 tctgaaattt ggggactgag tacagcaaat acggtagatc agtgggacac aacaggcctt
 541 tacagcttct ctgaacaaac caggtctctt gatggtcgtc ttcaggtgtc tcatcggaaa
 601 gggctgccac atgttatata ttgccggctg tggcgctggc cagaccttca cagccatcat
 661 gagctcaagg cgatcgagaa ctgcgaatac gctttcagtc tgaaaaaaga tgaagtgtgt
 721 gtgaaccctt accactacca gagggtggag acaccagtct tgcctccagt cttggtgcct
 781 cggcacacag agattctaac agaactgccg cctctggatg actataccca ctccattcca
 841 gaaaacacaa atttcccagc aggaattgag ccacagagta attacatccc agaaacacca
 901 ccacctggat atatcagtga agatggagaa actagtgacc aacagttgaa ccaaagtatg
 961 gacacaggct ctccggctga actgtctcct accactctct cccctgtcaa tcacagcttg
1021 gatttgcagc cagttactta ttcagaacct gcattttggt gttcaatcgc atattatgaa
1081 ctaaaccaga gggttggaga gaccttccat gcgtcacagc cctcactcac tgtagacggc
1141 tttacagatc catcgaactc ggagaggttc tgcttaggtt tgctctccaa cgttaacaga
1201 aacgctactg tagaaatgac cagaaggcat ataggaaggg gagtgcgctt gtattacata
1261 ggtggggaag tgtttgccga gtgcctaagt gatagtgcga tctttgtgca gagccccaac
1321 tgtaaccaga gatacggctg gcacccccgcg acagtgtgca aaatcccacc aggctgtaac
1381 ctgaagatct tcaacaacca agaatttgct gctcttctgg ctcagtctgt taaccagggt
1441 tttgaggccg tttatcagct gactcgaatg tgcaccataa gaatgagctt cgtgaagggg
1501 tggggagcag aataccggag gcagacagta acaagtactc cttgctggat tgaacttcat
1561 ctgaatggcc ccctgcagtg gttggacaaa gtattaactc agatgggatc cccgtcagtg
1621 cgatgctcaa gcatgtccta aagtccgtca gcagtggagc tcattggaag acttaacgta
1681 ccaactcctc cgccacagta ctcgtgtgtg atcccgtgga ctgtgctagt caaaacccag
1741 agcgaaaaca gcacttgagg tctcatcagt taaagcacct tgtggagtct gtttcctaca
1801 tttgaatttt agatggaaaa ttagtgtcta gaaatgccct ccccagaggg gacaaagaag
1861 acttaaagac ttaatgatgt ctcgttgggc ataagacagt gtcccaaagg ttattaatac
1921 cagtagtagt tgtgtacagt aatgtgtcca gacccagtat tgcagtgctc tgctgtttgt
1981 ataccttctt agtgtgcata aatgaggtgt gtgctgctgc ttggtctagg caagccttta
2041 taaaattaca gtacctaatc tgttattccc acttctccgt tatttttgtg tctttttttaa
2101 tatataatat atatatcgag attttcaaat tatcatttag aagcagattt tccttgtaga
2161 aactaatttt tctgcctttt accaaaaata aactcgtggg ggaagaaaag tggattaact
2221 tggaagtcct tgaccttaat gtgtccagtg ggtcttagca ttctttctgt gatcattttc
2281 tgctgaattg cattagaagg aaaccttgtt ggaaacttcc aggctctttg tgccatttct
2341 gttctgattc aaagcagtgc agcatgatgt cattgtggta aatagttgca ctgatggctt
2401 ctgggttagt tacttctgag tccagtaaag gattgtgtga gcagtaagtc cttttgtctt
2461 ctaaccagac ttcagcagat gataaccagt tgttccattg attaactttt gtctcaaacg
2521 tgcacaggtg acagtataat tattttcagg gctattctag aatcatctca gtatgtttcc
2581 ttcttccaac gccagtctga taataaagta tctttctgta aaggca
```

SEQ ID NO: 16 Rat Smad2 Amino Acid Sequence (NP_062064.1)

```
  1 mssilpftpp vvkrllgwkk saggsggagg geqngqeekw cekavkslvk klkktgrlde
 61 lekaittqnc ntkcvtipst cseiwglsta ntvdqwdttg lysfseqtrs ldgrlqvshr
121 kglphviycr lwrwpdlhsh helkaience yafslkkdev cvnpyhyqrv etpvlppvlv
181 prhteiltel pplddythsi pentnfpagi epqsnyipet pppgyisedg etsdqqlnqs
241 mdtgspaels pttlspvnhs ldlqpvtyse pafwcsiayy elnqrvgetf hasqpsltvd
301 gftdpsnser fclgllsnvn rnatvemtrr higrgvrlyy iggevfaecl sdsaifvqsp
361 ncnqrygwhp atvckippgc nlkifnnqef aallaqsvnq gfeavyqltr mctirmsfvk
421 gwgaeyrrqt vtstpcwiel hlngplqwld kvltqmgsps vrcssms
```

SEQ ID NO: 17 Human p63 transcript variant 1 mRNA Sequence (NM_003722.5; CDS: 128-2170)

```
  1 ctatgtctga tagcatttga ccctattgct tttagcctcc cggctttata tctatatata
 61 cacaggtata tgtgtatatt ttatataatt gttctccgtt cgttgatatc aaagacagtt
121 gaaggaaatg aattttgaaa cttcacggtg tgccacccta cagtactgcc ctgaccctta
181 catccagcgt ttcgtagaaa ccccagctca tttctcttgg aaagaaagtt attaccgatc
241 caccatgtcc cagagcacac agacaaatga attcctcagt ccagaggttt tccagcatat
301 ctgggatttt ctggaacagc ctatatgttc agttcagccc attgacttga actttgtgga
```

TABLE 1-continued

| | | | | | | |
|---|---|---|---|---|---|---|
| 361 | tgaaccatca | gaagatggtg | cgacaaacaa | gattgagatt | agcatggact | gtatccgcat |
| 421 | gcaggactcg | gacctgagtg | accccatgtg | gccacagtac | acgaacctgg | ggctcctgaa |
| 481 | cagcatggac | cagcagattc | agaacggctc | ctcgtccacc | agtccctata | acacagacca |
| 541 | cgcgcagaac | agcgtcacgg | cgccctcgcc | ctacgcacag | cccagctcca | ccttcgatgc |
| 601 | tctctctcca | tcacccgcca | tcccctccaa | caccgactac | ccaggcccgc | acagtttcga |
| 661 | cgtgtccttc | cagcagtcga | gcaccgccaa | gtcggccacc | tggacgtatt | ccactgaact |
| 721 | gaagaaactc | tactgccaaa | ttgcaaagac | atgccccatc | cagatcaagg | tgatgacccc |
| 781 | acctcctcag | ggagctgtta | tccgcgccat | gcctgtctac | aaaaaagctg | agcacgtcac |
| 841 | ggaggtggtg | aagcggtgcc | ccaaccatga | gctgagccgt | gaattcaacg | agggacagat |
| 901 | tgcccctcct | agtcatttga | ttcgagtaga | ggggaacagc | catgcccagt | atgtagaaga |
| 961 | tcccatcaca | ggaagacaga | gtgtgctggt | accttatgag | ccaccccagg | ttggcactga |
| 1021 | attcacgaca | gtcttgtaca | atttcatgtg | taacagcagt | tgtgttggag | ggatgaaccg |
| 1081 | ccgtccaatt | ttaatcattg | ttactctgga | aaccagagat | gggcaagtcc | tgggccgacg |
| 1141 | ctgctttgag | gcccggatct | gtgcttgccc | aggaagagac | aggaaggcgg | atgaagatag |
| 1201 | catcagaaag | cagcaagttt | cggacagtac | aaagaacggt | gatggtacga | agcgcccgtt |
| 1261 | tcgtcagaac | acacatggta | tccagatgac | atccatcaag | aaacgaagat | ccccagatga |
| 1321 | tgaactgtta | tacttaccag | tgagggggccg | tgagacttat | gaaatgctgt | tgaagatcaa |
| 1381 | agagtccctg | gaactcatgc | agtaccttcc | tcagcacaca | attgaaacgt | acaggcaaca |
| 1441 | gcaacagcag | cagcaccagc | acttacttca | gaaacagacc | tcaatacagt | ctccatcttc |
| 1501 | atatggtaac | agctccccac | ctctgaacaa | aatgaacagc | atgaacaagc | tgccttctgt |
| 1561 | gagccagctt | atcaaccctc | agcagcgcaa | cgccctcact | cctacaacca | ttcctgatgg |
| 1621 | catgggagcc | aacattccca | tgatgggcac | ccacatgcca | atggctggag | acatgaatgg |
| 1681 | actcagcccc | acccaggcac | tccctccccc | actctccatg | ccatccacct | cccactgcac |
| 1741 | acccccacct | ccgtatccca | cagattgcag | cattgtcagt | ttcttagcga | ggttgggctg |
| 1801 | ttcatcatgt | ctggactatt | tcacgaccca | ggggctgacc | accatctatc | agattgagca |
| 1861 | ttactccatg | gatgatctgg | caagtctgaa | aatccctgag | caatttcgac | atgcgatctg |
| 1921 | gaagggcatc | ctggaccacc | ggcagctcca | cgaattctcc | tccccttctc | atctcctgcg |
| 1981 | gaccccaagc | agtgcctcta | cagtcagtgt | gggctccagt | gagacccggg | gtgagcgtgt |
| 2041 | tattgatgct | gtgcgattca | ccctccgcca | gaccatctct | ttcccacccc | gagatgagtg |
| 2101 | gaatgacttc | aactttgaca | tggatgctcg | ccgcaataag | caacagcgca | tcaaagagga |
| 2161 | gggggagtga | gcctcaccat | gtgagctctt | cctatccctc | tcctaactgc | cagcccccta |
| 2221 | aaagcactcc | tgcttaatct | tcaaagcctt | ctccctagct | cctccccttc | ctcttgtctg |
| 2281 | atttcttagg | ggaaggagaa | gtaagaggct | acctcttacc | taacatctga | cctggcatct |
| 2341 | aattctgatt | ctggctttaa | gccttcaaaa | ctatagcttg | cagaactgta | gctgccatgg |
| 2401 | ctaggtagaa | gtgagcaaaa | aagagttggg | tgtctcctta | agctgcagag | atttctcatt |
| 2461 | gacttttata | aagcatgttc | acccttatag | tctaagacta | tatatataaa | tgtataaata |
| 2521 | tacagtatag | atttttgggt | gggggggcatt | gagtattgtt | taaaatgtaa | tttaaatgaa |
| 2581 | agaaaattga | gttgcactta | ttgaccattt | tttaatttac | ttgttttgga | tggcttgtct |
| 2641 | atactccttc | ccttaagggg | tatcatgtat | ggtgataggt | atctagagct | taatgctaca |
| 2701 | tgtgagtgac | gatgatgtac | agattctttc | agttctttgg | attctaaata | catgccacat |
| 2761 | caaacctttg | agtagatcca | tttccattgc | ttattatgta | ggtaagactg | tagatatgta |
| 2821 | ttcttttctc | agtgttggta | tattttatat | tactgacatt | tcttctagtg | atgatggttc |
| 2881 | acgttggggt | gatttaatcc | agttataaga | agaagttcat | gtccaaacgt | cctctttagt |
| 2941 | ttttggttgg | gaatgaggaa | aattcttaaa | aggcccatag | cagccagttc | aaaaacaccc |
| 3001 | gacgtcatgt | atttgagcat | atcagtaacc | cccttaaatt | taataccaga | taccttatct |
| 3061 | tacaatattg | attgggaaaa | catttgctgc | cattacagag | gtattaaaac | taaatttcac |
| 3121 | tactagattg | actaactcaa | atacacattt | gctactgttg | taagaattct | gattgatttg |
| 3181 | attgggatga | atgccatcta | tctagttcta | acagtgaagt | tttactgtct | attaatattc |
| 3241 | agggtaaata | ggaatcattc | agaaatgttg | agtctgtact | aaacagtaag | atatctcaat |
| 3301 | gaaccataaa | ttcaactttg | taaaaatctt | ttgaagcata | gataatattg | tttggtaaat |
| 3361 | gtttcttttg | tttggtaaat | gtttctttta | aagaccctcc | tattctataa | aactctgcat |
| 3421 | gtagaggctt | gtttaccttt | ctctctctaa | ggtttacaat | aggagtggtg | atttgaaaaa |
| 3481 | tataaaatta | tgagattggt | tttcctgtgg | cataaattgc | atcactgtat | cattttcttt |
| 3541 | tttaaccggt | aagagtttca | gtttgttgga | aagtaactgt | gagaacccag | tttcccgtcc |
| 3601 | atctccctta | gggactaccc | atagacatga | aaggtcccca | cagagcaaga | gataagtctt |
| 3661 | tcatggctgc | tgttgcttaa | accacttaaa | cgaagagttc | ccttgaaact | ttgggaaaac |
| 3721 | atgttaatga | caatattcca | gatctttcag | aaatataaca | catttttttg | catgcatgca |
| 3781 | aatgagctct | gaaatcttcc | catgcattct | ggtcaagggc | tgtcattgca | cataagcttc |
| 3841 | cattttaatt | ttaaagtgca | aaagggccag | cgtggctcta | aaaggtaatg | tgtggattgc |
| 3901 | ctctgaaaag | tgtgtatata | ttttgtgtga | aattgcatac | tttgtatttt | gattattttt |
| 3961 | tttttcttct | tgggatagtg | ggatttccag | aaccacactt | gaaacctttt | tttatcgttt |
| 4021 | ttgtattttc | atgaaaatac | catttagtaa | gaataccaca | tcaaataaga | aataatgcta |
| 4081 | caattttaag | aggggaggga | agggaaagtt | tttttttatt | atttttttaa | aattttgtat |
| 4141 | gttaaagaga | atgagtcctt | gatttcaaag | ttttgttgta | cttaaatggt | aataagcact |
| 4201 | gtaaacttct | gcaacaagca | tgcagctttg | caaacccatt | aaggggaaga | atgaaagctg |
| 4261 | ttccttggtc | ctagtaagaa | gacaaactgc | ttcccttact | ttgctgaggg | tttgaataaa |
| 4321 | cctaggactt | ccgagctatg | tcagtactat | tcaggtaaca | ctagggcctt | ggaaattcct |
| 4381 | gtactgtgtc | tcatggattt | ggcactagcc | aaagcgaggc | acccttactg | gcttacctcc |
| 4441 | tcatggcagc | ctactctcct | tgagtgtatg | agtagccagg | gtaaggggta | aaaggatagt |
| 4501 | aagcatagaa | accactagaa | agtgggctta | atggagttct | tgtggcctca | gctcaatgca |
| 4561 | gttagctgaa | gaattgaaaa | gtttttgttt | ggagacgttt | ataaacagaa | atggaaagca |
| 4621 | gagttttcat | taaatccttt | taccttttt | ttttcttggt | aatcccctaa | aataacagta |
| 4681 | tgtgggatat | tgaatgttaa | agggatattt | ttttctatta | tttttataat | tgtacaaaat |
| 4741 | taagcaaatg | ttaaaagttt | tatatgcttt | attaatgttt | tcaaaaggta | ttatacatgt |
| 4801 | gatacatttt | ttaagcttca | gttgcttgtc | ttctggtact | ttctgttatg | ggcttttggg |
| 4861 | gagccagaag | ccaatctaca | atctcttttt | gtttgccagg | acatgcaata | aaatttaaaa |
| 4921 | aataaataaa | aactaattaa | gaaa | | | |

TABLE 1-continued

```
SEQ ID NO: 18 Human p63 Isoform 1  Amino Acid Sequence (NP_003713.3)
   1 mnfetsrcat lqycpdpyiq rfvetpahfs wkesyyrstm sqstqtnefl spevfqhiwd
  61 fleqpicsvq pidlnfvdep sedgatnkie ismdcirmqd sdlsdpmwpq ytnlgllnsm
 121 dqqiqngsss tspyntdhaq nsvtapspya qpsstfdals pspaipsntd ypgphsfdvs
 181 fqqsstaksa twtystelkk lycqiaktcp iqikvmtppp qgavirampv ykkaehvtev
 241 vkrcpnhels refnegqiap pshlirvegn shaqyvedpi tgrqsvlvpy eppqvgteft
 301 tvlynfmcns scvggmnrrp iliivtletr dgqvlgrrcf earicacpgr drkadedsir
 361 kqqvsdstkn gdgtkrpfrq nthgiqmtsi kkrrspddel lylpvrgret yemllkikes
 421 lelmqylpqh tietyrqqqq qqhqhllqkq tsiqspssyg nssppln kmn smnklpsvsq
 481 linpqqrnal tpttipdgmg anipmmgthm pmagdmngls ptqalpppls mpstshctpp
 541 ppyptdcsiv sflarlgcss cldyfttqgl ttiyqiehys mddlaslkip eqfrhaiwkg
 601 ildhrqlhef sspshllrtp ssastvsvgs setrgervid avrftlrqti sfpprdewnd
 661 fnfdmdarrn kqqrikeege

SEQ ID NO: 19 Human p63 transcript variant 2 mRNA Sequence
NM_001114978.2; CDS: 128-1795)
   1 ctatgtctga tagcatttga ccctattgct tttagcctcc cggctttata tctatatata
  61 cacaggtata tgtgtatatt ttatataatt gttctccgtt cgttgatatc aaagacagtt
 121 gaaggaaatg aatttgaaa cttcacggtg tgccacccta cagtactgcc ctgaccctta
 181 catccagcgt ttcgtagaaa ccccagctca tttctcttgg aaagaaagtt attaccgatc
 241 caccatgtcc cagagcacac agacaaatga attcctcagt ccagaggttt tccagcatat
 301 ctgggatttt ctggaacagc ctatatgttc agttcagccc attgacttga actttgtgga
 361 tgaaccatca gaagatggtg cgacaaacaa gattgagatt agcatggact gtatccgcat
 421 gcaggactcg gacctgagtg accccatgtg gccacagtac acgaacctgg ggctcctgaa
 481 cagcatggac cagcagattc agaacggctc ctcgtccacc agtccctata acacagacca
 541 cgcgcagaac agcgtcacgg cgccctcgcc ctacgcacag cccagctcca ccttcgatgc
 601 tctctctcca tcacccgcca tcccctccaa caccgactac ccaggcccgc acagtttcga
 661 cgtgtccttc cagcagtcga gcaccgccaa gtcggccacc tggacgtatt ccactgaact
 721 gaagaaactc tactgccaaa ttgcaaagac atgccccatc cagatcaagg tgatgacccc
 781 acctcctcag ggagctgtta tccgcgccat gcctgtctac aaaaaagctg agcacgtcac
 841 ggaggtggtg aagcggtgcc ccaaccatga gctgagccgt gaattcaacg agggacagat
 901 tgcccctcct agtcatttga ttcgagtaga ggggaacagc catgcccagt atgtagaaga
 961 tcccatcaca ggaagacaga gtgtgctggt accttatgag ccaccccagg ttggcactga
1021 attcacgaca gtcttgtaca atttcatgtg taacagcagt tgtgttggag ggatgaaccg
1081 ccgtccaatt ttaatcattg ttactctgga aaccagagat gggcaagtcc tgggccgacg
1141 ctgctttgag gcccggatct gtgcttgccc aggaagagac aggaaggcgg atgaagatag
1201 catcagaaag cagcaagttt cggacagtac aaagaacggt gatggtacga agcgcccgtt
1261 tcgtcagaac acacatggta tccagatgac atccatcaag aaacgaagat ccccagatga
1321 tgaactgtta tacttaccag tgaggggccg tgagacttat gaaatgctgt tgaagatcaa
1381 agagtccctg gaactcatgc agtaccttcc tcagcacaca attgaaacgt acaggcaaca
1441 gcaacagcag cagcaccagc acttacttca gaaacagacc tcaatacagt ctccatcttc
1501 atatggtaac agctccccac ctctgaacaa aatgaacagc atgaacaagc tgccttctgt
1561 gagccagctt atcaaccctc agcagcgcaa cgccctcact cctacaacca ttcctgatgg
1621 catgggagcc aacattccca tgatgggcac ccacatgcca atggctggag acatgaatgg
1681 actcagcccc acccaggcac tccctccccc actctccatg ccatccacct cccactgcac
1741 acccccacct ccgtatccca cagattgcag cattgtcagg atctggcaag tctgaaaatc
1801 cctgagcaat ttcgacatgc gatctggaag ggcatcctgg accaccggca gctccacgaa
1861 ttctcctccc cttctcatct cctgcggacc ccaagcagtg cctctacagt cagtgtgggc
1921 tccagtgaga cccggggtga gcgtgttatt gatgctgtgc gattcaccct ccgccagacc
1981 atctctttcc caccccgaga tgagtggaat gacttcaact ttgacatgga tgctcgccgc
2041 aataagcaac agcgcatcaa agaggagggg gagtgagcct caccatgtga gctcttccta
2101 tccctctcct aactgccagc cccctaaaag cactcctgct taatcttcaa agccttctcc
2161 ctagctcctc cccttcctct tgtctgattt cttaggggaa ggagaagtaa gaggctacct
2221 cttacctaac atctgacctg gcatctaatt ctgattctgg ctttaagcct tcaaaactat
2281 agcttgcaga actgtagctg ccatggctag gtagaagtga gcaaaaaaga gttgggtgtc
2341 tccttaagct gcagagattt ctcattgact tttataaagc atgttcaccc ttatagtcta
2401 agactatata tataaatgta taaatataca gtatagattt ttgggtgggg ggcattgagt
2461 attgtttaaa atgtaattta aatgaaagaa aattgagttg cacttattga ccattttta
2521 atttacttgt tttggatggc ttgtctatac tccttccctt aaggggtatc atgtatggtg
2581 ataggtatct agagcttaat gctacatgtg agtgacgatg atgtacagat tctttcagtt
2641 ctttggattc taaatacatg ccacatcaaa cctttgagta gatccatttc cattgcttat
2701 tatgtaggta agactgtaga tatgtattct tttctcagtg ttggtatatt ttatattact
2761 gacatttctt ctagtgatga tggttcacgt tggggtgatt taatccagtt ataagaagaa
2821 gttcatgtcc aaacgtcctc tttagttttt ggttgggaat gaggaaaatt cttaaaaggc
2881 ccatagcagc cagttcaaaa acacccgacg tcatgtattt gagcatatca gtaacccct
2941 taaatttaat accagatacc ttatcttaca atattgattg ggaaaacatt tgctgccatt
3001 acagaggtat taaaactaaa tttcactact agattgacta actcaaatac acatttgcta
3061 ctgttgtaag aattctgatt gatttgattg ggatgaatgc catctatcta gttctaacag
3121 tgaagtttta ctgtctatta atattcaggg taaataggaa tcattcagaa atgttgagtc
3181 tgtactaaac agtaagatat ctcaatgaac cataaattca actttgtaaa aatcttttga
3241 agcatagata atattgtttg gtaaatgttt cttttgtttg gtaaatgttt cttttaaaga
3301 ccctcctatt ctataaaact ctgcatgtag aggcttgttt acctttctct ctctaaggtt
3361 tacaatagga gtggtgattt gaaaaatata aaattatgag attggttttc ctgtggcata
3421 aattgcatca ctgtatcatt ttcttttta accggtaaga gtttcagttt gttggaaagt
3481 aactgtgaga acccagtttc ccgtccatct cccttaggga ctacccatag acatgaaagg
3541 tccccacaga gcaagagata agtctttcat ggctgctgtt gcttaaacca cttaaacgaa
3601 gagttccctt gaaactttgg gaaaacatgt taatgacaat attccagatc tttcagaaat
3661 ataacacatt tttttgcatg catgcaaatg agctctgaaa tcttcccatg cattctggtc
3721 aagggctgtc attgcacata agcttccatt ttaattttaa agtgcaaaag ggccagcgtg
3781 gctctaaaag gtaatgtgtg gattgcctct gaaaagtgtg tatatatttt gtgtgaaatt
```

TABLE 1-continued 3841 gcatactttg tattttgatt attttttttt tcttcttggg atagtgggat ttccagaacc
3901 acacttgaaa ccttttttta tcgtttttgt attttcatga aaataccatt tagtaagaat
3961 accacatcaa ataagaaata atgctacaat tttaagaggg gagggaaggg aaagtttttt
4021 tttattattt ttttaaaatt ttgtatgtta aagagaatga gtccttgatt tcaaagtttt
4081 gttgtactta aatggtaata agcactgtaa acttctgcaa caagcatgca gctttgcaaa
4141 cccattaagg ggaagaatga aagctgttcc ttggtcctag taagaagaca aactgcttcc
4201 cttactttgc tgagggtttg aataaaccta ggacttccga gctatgtcag tactattcag
4261 gtaacactag ggccttggaa attcctgtac tgtgtctcat ggatttggca ctagccaaag
4321 cgaggcaccc ttactggctt acctcctcat ggcagcctac tctccttgag tgtatgagta
4381 gccagggtaa ggggtaaaag gatagtaagc atagaaacca ctagaaagtg ggcttaatgg
4441 agttcttgtg gcctcagctc aatgcagtta gctgaagaat tgaaaagttt ttgtttggag
4501 acgtttataa acagaaatgg aaagcagagt tttcattaaa tcctttttacc ttttttttt
4561 cttggtaatc ccctaaaata acagtatgtg ggatattgaa tgttaaaggg atattttttt
4621 ctattatttt tataattgta caaaattaag caaatgttaa aagttttata tgctttatta
4681 atgttttcaa aaggtattat acatgtgata catttttttaa gcttcagttg cttgtcttct
4741 ggtactttct gttatgggct tttggggagc cagaagccaa tctacaatct ctttttgttt
4801 gccaggacat gcaataaaat ttaaaaaata aataaaaact aattaagaaa SEQ ID NO: 20 Human p63 Isoform 2 Amino Acid Sequence (NP_001108450.1)
1 mnfetsrcat lqycpdpyiq rfvetpahfs wkesyyrstm sqstqtnefl spevfqhiwd
61 fleqpicsvq pidlnfvdep sedgatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdstkn gdgtkrpfrq nthgiqmtsi kkrrspddel lylpvrgret yemllkikes
421 lelmqylpqh tietyrqqqq qqhqhliqkq tsiqspssyg nssppplnkmn smnklpsvsq
481 linpqqrnal tpttipdgmg anipmmgthm pmagdmngls ptqalpppls mpstshctpp
541 ppyptdcsiv riwqv SEQ ID NO: 21 Human p63 transcript variant 3 mRNA Sequence
(NM_001114979.2; CDS: 128-1591)
1 ctatgtctga tagcatttga ccctattgct tttagcctcc cggctttata tctatatata
61 cacaggtata tgtgtatatt ttatataatt gttctccgtt cgttgatatc aaagacagtt
121 gaaggaaatg aattttgaaa cttcacggtg tgccacccta cagtactgcc ctgaccctta
181 catccagcgt ttcgtagaaa ccccagctca tttctcttgg aaagaaagtt attaccgatc
241 caccatgtcc cagagcacac agacaaatga attcctcagt ccagaggttt tccagcatat
301 ctgggatttt ctggaacagc ctatatgttc agttcagccc attgacttga actttgtgga
361 tgaaccatca gaagatggtg cgacaaacaa gattgagatt agcatggact gtatccgcat
421 gcaggactcg gacctgagtg accccatgtg gccacagtac acgaacctgg ggctcctgaa
481 cagcatggac cagcagattc agaacggctc ctcgtccacc agtccctata acacagacca
541 cgcgcagaac agcgtcacgg cgccctcgcc ctacgcacag cccagctcca ccttcgatgc
601 tctctctcca tcacccgcca tcccctccaa caccgactac ccaggcccgc acagtttcga
661 cgtgtccttc cagcagtcga gcaccgccaa gtcggccacc tggacgtatt ccactgaact
721 gaagaaactc tactgccaaa ttgcaaagac atgccccatc cagatcaagg tgatgacccc
781 acctcctcag ggagctgtta tccgcgccat gcctgtctac aaaaaagctg agcacgtcac
841 ggaggtggtg aagcggtgcc ccaaccatga gctgagccgt gaattcaacg agggacagat
901 tgcccctcct agtcatttga ttcgagtaga ggggaacagc catgcccagt atgtagaaga
961 tcccatcaca ggaagacaga gtgtgctggt accttatgag ccaccccagg ttggcactga
1021 attcacgaca gtcttgtaca atttcatgtg taacagcagt tgtgttggag ggatgaaccg
1081 ccgtccaatt ttaatcattg ttactctgga aaccagagat gggcaagtcc tgggccgacg
1141 ctgctttgag gcccggatct gtgcttgccc aggaagagac aggaaggcgg atgaagatag
1201 catcagaaag cagcaagttt cggacagtac aaagaacggt gatggtacga agcgcccgtt
1261 tcgtcagaac acacatggta tccagatgac atccatcaag aaacgaagat ccccagatga
1321 tgaactgtta tacttaccag tgagggggcg tgagacttat gaaatgctgt tgaagatcaa
1381 agagtccctg gaactcatgc agtaccttcc tcagcacaca attgaaacgt acaggcaaca
1441 gcaacagcag cagcaccagc acttacttca gaaacatctc ctttcagcct gcttcaggaa
1501 tgagcttgtg gagccccgga gagaaactcc aaaacaatct gacgtcttct ttagacattc
1561 caagccccca aaccgatcag tgtacccata gagccctatc tctatatttt aagtgtgtgt
1621 gttgtatttc catgtgtata tgtgagtgtg tgtgtgtgta tgtgtgtgcg tgtgtatcta
1681 gccctcataa acaggacttg aagacacttt ggctcagaga cccaactgct caaaggcaca
1741 aagccactag tgagagaatc ttttgaaggg actcaaacct ttacaagaaa ggatgttttc
1801 tgcagatttt gtatccttag accggccatt ggtgggtgag gaaccactgt gtttgtctgt
1861 gagctttctg ttgtttcctg ggagggaggg gtcaggtggg gaaaggggca ttaagatgtt
1921 tattggaacc cttttctgtc ttcttctgtt gtttttctaa aattcacagg gaagcttttg
1981 agcaggtctc aaacttaaga tgtcttttta agaaaaggag aaaaaagttg ttattgtctg
2041 tgcataagta agttgtaggt gactgagaga ctcagtcaga ccctttttaat gctggtcatg
2101 taataatatt gcaagtagta agaaacgaag gtgtcaagtg tactgctggg cagcgaggtg
2161 atcattacca aaagtaatca actttgtggg tggagagttc tttgtgagaa cttgcattat
2221 ttgtgtcctc ccctcatgtg taggtagaac atttcttaat gctgtgtacc tgcctctgcc
2281 actgtatgtt ggcatctgtt atgctaaagt ttttcttgta catgaaaccc tggaagacct
2341 actacaaaaa aactgttgtt tggcccccat agcaggtgaa ctcattttgt gcttttaata
2401 gaaagacaaa tccaccccag taatattgcc cttacgtagt tgtttaccat tattcaaagc
2461 tcaaaataga atttgaagcc ctctcacaaa atctgtgatt aatttgctta attagagctt
2521 ctatccctca agcctaccta ccataaaacc agccatatta ctgatactgt tcagtgcatt
2581 tagccaggag acttacgttt tgagtaagtg agatccaagc agacgtgtta aaatcagcac TABLE 1-continued

```
2641 tcctggactg gaaattaaag attgaaaggg tagactactt ttcttttttt tactcaaaag
2701 tttagagaat ctctgtttct ttccatttta aaaacatatt ttaagataat agcataaaga
2761 ctttaaaaat gttcctcccc tccatcttcc cacacccagt caccagcact gtattttctg
2821 tcaccaagac aatgatttct tgttattgag gctgttgctt ttgtggatgt gtgattttaa
2881 ttttcaataa acttttgcat cttggtttat cttgca

SEQ ID NO: 22 Human p63 Isoform 3 Amino Acid Sequence (NP_001108451.1)
  1 mnfetsrcat lqycpdpyiq rfvetpahfs wkesyyrstm sqstqtnefl spevfqhiwd
 61 fleqpicsvq pidlnfvdep sedgatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdstkn gdgtkrpfrq nthgiqmtsi kkrrspddel lylpvrgret yemllkikes
421 lelmqylpqh tietyrqqqq qqhqhllqkh llsacfrnel veprretpkq sdvffrhskp
481 pnrsvyp

SEQ ID NO: 23 Human p63 transcript variant 4 mRNA Sequence
(NM_001114980.2; CDS: 143-1903)
   1 cagagagaga aagagagaga gggacttgag ttctgttatc ttcttaagta gattcatatt
  61 gtaagggtct cggggtgggg gggttggcaa aatcctggag ccagaagaaa ggacagcagc
 121 attgatcaat cttacagcta acatgttgta cctggaaaac aatgcccaga ctcaatttag
 181 tgagccacag tacacgaacc tggggctcct gaacagcatg gaccagcaga ttcagaacgg
 241 ctcctcgtcc accagtccct ataacacaga ccacgcgcag aacagcgtca cggcgccctc
 301 gccctacgca cagcccagct ccaccttcga tgctctctct ccatcacccg ccatcccctc
 361 caacaccgac tacccaggcc cgcacagttt cgacgtgtcc ttccagcagt cgagcaccgc
 421 caagtcggcc acctggacgt attccactga actgaagaaa ctctactgcc aaattgcaaa
 481 gacatgcccc atccagatca aggtgatgac cccacctcct cagggagctg ttatccgcgc
 541 catgcctgtc tacaaaaaag ctgagcacgt cacggaggtg gtgaagcggt gccccaacca
 601 tgagctgagc cgtgaattca acgagggaca gattgcccct cctagtcatt tgattcgagt
 661 agaggggaac agccatgccc agtatgtaga agatcccatc acaggaagac agagtgtgct
 721 ggtaccttat gagccacccc aggttggcac tgaattcacg acagtcttgt acaatttcat
 781 gtgtaacagc agttgtgttg gagggatgaa ccgccgtcca attttaatca ttgttactct
 841 ggaaaccaga gatgggcaag tcctgggccg acgctgcttt gaggcccgga tctgtgcttg
 901 cccaggaaga gacaggaagg cggatgaaga tagcatcaga aagcagcaag tttcggacag
 961 tacaaagaac ggtgatggta cgaagcgccc gtttcgtcag aacacacatg gtatccagat
1021 gacatccatc aagaaacgaa gatccccaga tgatgaactg ttatacttac cagtgagggg
1081 ccgtgagact tatgaaatgc tgttgaagat caaagagtcc ctggaactca tgcagtacct
1141 tcctcagcac acaattgaaa cgtacaggca acagcaacag cagcagcacc agcacttact
1201 tcagaaacag acctcaatac agtctccatc ttcatatggt aacagctccc cacctctgaa
1261 caaaatgaac agcatgaaca agctgccttc tgtgagccag cttatcaacc ctcagcagcg
1321 caacgccctc actcctacaa ccattcctga tggcatggga gccaacattc ccatgatggg
1381 cacccacatg ccaatggctg gagacatgaa tggactcagc cccacccagg cactccctcc
1441 cccactctcc atgccatcca cctcccactg cacacccccca cctccgtatc ccacagattg
1501 cagcattgtc agtttcttag cgaggttggg ctgttcatca tgtctggact atttcacgac
1561 ccaggggctg accaccatct atcagattga gcattactcc atggatgatc tggcaagtct
1621 gaaaatccct gagcaatttc gacatgcgat ctggaagggc atcctggacc accggcagct
1681 ccacgaattc tcctcccctt ctcatctcct gcggacccca agcagtgcct ctacagtcag
1741 tgtgggctcc agtgagaccc ggggtgagcg tgttattgat gctgtgcgat tcaccctccg
1801 ccagaccatc tctttcccac cccgagatga gtggaatgac ttcaactttg acatggatgc
1861 tcgccgcaat aagcaacagc gcatcaaaga ggaggggggag tgagcctcac catgtgagct
1921 cttcctatcc ctctcctaac tgccagcccc ctaaaagcac tcctgcttaa tcttcaaagc
1981 cttctcccta gctcctcccc ttcctcttgt ctgatttctt aggggaagga gaagtaagag
2041 gctacctctt acctaacatc tgacctggca tctaattctg attctggctt taagccttca
2101 aaactatagc ttgcagaact gtagctgcca tggctaggta gaagtgagca aaaaagagtt
2161 gggtgtctcc ttaagctgca gagatttctc attgactttt ataaagcatg ttcaccctta
2221 tagtctaaga ctatatatat aaatgtataa atatacagta tagatttttg ggtggggggc
2281 attgagtatt gtttaaaatg taatttaaat gaaagaaaat tgagttgcac ttattgacca
2341 tttttttaatt tacttgtttt ggatggcttg tctatactcc ttcccttaag ggtatcatg
2401 tatggtgata ggtatctaga gcttaatgct acatgtgagt gacgatgatg tacagattct
2461 ttcagttctt tggattctaa atacatgcca catcaaacct ttgagtagat ccatttccat
2521 tgcttattat gtaggtaaga ctgtagatat gtattctttt ctcagtgttg gtatatttta
2581 tattactgac atttcttcta gtgatgatgg ttcacgttgg ggtgatttaa tccagttata
2641 agaagaagtt catgtccaaa cgtcctcttt agtttttggt tgggaatgag gaaaattctt
2701 aaaaggccca tagcagccag ttcaaaaaca cccgacgtca tgtatttgag catatcagta
2761 accccttaa atttaatacc agataccttta tcttacaata ttgattggga aaacatttgc
2821 tgccattaca gaggtattaa aactaaattt cactactaga ttgactaact caaatacaca
2881 tttgctactg ttgtaagaat tctgattgat ttgattggga tgaatgccat ctatctagtt
2941 ctaacagtga agttttactg tctattaata ttcagggtaa ataggaatca ttcagaaatg
3001 ttgagtctgt actaaacagt aagatatctc aatgaaccat aaattcaact ttgtaaaaat
3061 cttttgaagc atagataata ttgtttggta aatgtttctt ttgtttggta aatgtttctt
3121 ttaaagaccc tcctattcta taaaactctg catgtagagg cttgtttacc tttctctctc
3181 taaggtttac aataggagtg gtgatttgaa aaatataaaa ttatgagatt ggttttcctg
3241 tggcataaat tgcatcactg tatcattttc ttttttaacc ggtaagagtt tcagtttgtt
3301 ggaaagtaac tgtgagaacc cagtttcccg tccatctccc ttagggacta cccatagaca
3361 tgaaaggtcc ccacagagca agagataagt ctttcatggc tgctgttgct taaaccactt
3421 aaacgaagag ttcccttgaa actttgggaa aacatgttaa tgacaatatt ccagatcttt
3481 cagaaatata acacattttt ttgcatgcat gcaaatgagc tctgaaatct tcccatgcat
3541 tctggtcaag ggctgtcatt gcacataagc ttccatttta attttaaagt gcaaaagggc
3601 cagcgtggct ctaaaaggta atgtgtggat tgcctctgaa aagtgtgtat atattttgtg
```

TABLE 1-continued

```
3661 tgaaattgca tactttgtat tttgattatt tttttttct tcttgggata gtgggatttc
3721 cagaaccaca cttgaaacct tttttatcg tttttgtatt ttcatgaaaa taccatttag
3781 taagaatacc acatcaaata agaaataatg ctacaatttt aagaggggag ggaagggaaa
3841 gttttttttt attatttttt taaaattttg tatgttaaag agaatgagtc cttgatttca
3901 aagttttgtt gtacttaaat ggtaataagc actgtaaact tctgcaacaa gcatgcagct
3961 ttgcaaaccc attaagggga agaatgaaag ctgttccttg gtcctagtaa gaagacaaac
4021 tgcttccctt actttgctga gggtttgaat aaacctagga cttccgagct atgtcagtac
4081 tattcaggta acactagggc cttggaaatt cctgtactgt gtctcatgga tttggcacta
4141 gccaaagcga ggcaccctta ctggcttacc tcctcatggc agcctactct ccttgagtgt
4201 atgagtagcc agggtaaggg gtaaaaggat agtaagcata gaaaccacta gaaagtgggc
4261 ttaatggagt tcttgtggcc tcagctcaat gcagttagct gaagaattga aaagtttttg
4321 tttggagacg tttataaaca gaaatggaaa gcagagtttt cattaaatcc ttttaccttt
4381 tttttttctt ggtaatcccc taaaataaca gtatgtggga tattgaatgt taaagggata
4441 tttttttcta ttatttttat aattgtacaa aattaagcaa atgttaaaag ttttatatgc
4501 tttattaatg ttttcaaaag gtattataca tgtgatacat tttttaagct tcagttgctt
4561 gtcttctggt actttctgtt atgggctttt ggggagccag aagccaatct acaatctctt
4621 tttgtttgcc aggacatgca ataaaattta aaaaataaat aaaaactaat taagaaa
```

SEQ ID NO: 24 Human p63 Isoform 4 Amino Acid Sequence (NP_001108452.1)

```
  1 mlylennaqt qfsepqytnl gllnsmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdstkngdgt krpfrqnthg iqmtsikkrr
301 spddellylp vrgretyeml lkikeslelm qylpqhtiet yrqqqqqhq hllqkqtsiq
361 spssygnssp plnkmnsmnk lpsysqlinp qqrnaltptt ipdgmganip mmgthmpmag
421 dmnglsptqa lppplsmpst shctppppyp tdcsivsfla rlgcsscldy fttqglttiy
481 qiehysmddl aslkipeqfr haiwkgildh rqlhefssps hllrtpssas tvsvgssetr
541 gervidavrf tlrqtisfpp rdewndfnfd mdarrnkqqr ikeege
```

SEQ ID NO: 25 Human p63 transcript variant 5 mRNA Sequence
(NM_001114981.2; CDS: 143-1528)

```
   1 cagagagaga aagagagaga gggacttgag ttctgttatc ttcttaagta gattcatatt
  61 gtaagggtct cggggtgggg gggttggcaa aatcctggag ccagaagaaa ggacagcagc
 121 attgatcaat cttacagcta acatgttgta cctggaaaac aatgcccaga ctcaatttag
 181 tgagccacag tacacgaacc tggggctcct gaacagcatg gaccagcaga ttcagaacgg
 241 ctcctcgtcc accagtccct ataacacaga ccacgcgcag aacagcgtca cggcgccctc
 301 gccctacgca cagcccagct ccaccttcga tgctctctct ccatcacccg ccatcccctc
 361 caacaccgac tacccaggcc cgcacagttt cgacgtgtcc ttccagcagt cgagcaccgc
 421 caagtcggcc acctggacgt attccactga actgaagaaa ctctactgcc aaattgcaaa
 481 gacatgcccc atccagatca aggtgatgac cccacctcct cagggagctg ttatccgcgc
 541 catgcctgtc tacaaaaaag ctgagcacgt cacggaggtg gtgaagcggt gccccaacca
 601 tgagctgagc cgtgaattca acgagggaca gattgcccct cctagtcatt tgattcgagt
 661 agaggggaac agccatgccc agtatgtaga agatcccatc acaggaagac agagtgtgct
 721 ggtaccttat gagccacccc aggttggcac tgaattcacg acagtcttgt acaatttcat
 781 gtgtaacagc agttgtgttg gagggatgaa ccgccgtcca attttaatca ttgttactct
 841 ggaaaccaga gatgggcaag tcctgggccg acgctgcttt gaggcccgga tctgtgcttg
 901 cccaggaaga gacaggaagg cggatgaaga tagcatcaga aagcagcaag tttcggacag
 961 tacaaagaac ggtgatggta cgaagcgccc gtttcgtcag aacacacatg gtatccagat
1021 gacatccatc aagaaacgaa gatccccaga tgatgaactg ttatacttac cagtgagggg
1081 ccgtgagact tatgaaatgc tgttgaagat caaagagtcc ctggaactca tgcagtacct
1141 tcctcagcac acaattgaaa cgtacaggca acagcaacag cagcagcacc agcacttact
1201 tcagaaacag acctcaatac agtctccatc ttcatatggt aacagctccc cacctctgaa
1261 caaaatgaac agcatgaaca agctgccttc tgtgagccag cttatcaacc ctcagcagcg
1321 caacgccctc actcctacaa ccattcctga tggcatggga gccaacattc ccatgatggg
1381 cacccacatg ccaatggctg gagacatgaa tggactcagc cccacccagg cactccctcc
1441 cccactctcc atgccatcca cctcccactg cacaccccca cctccgtatc ccacagattg
1501 cagcattgtc aggatctggc aagtctgaaa atccctgagc aatttcgaca tgcgatctgg
1561 aagggcatcc tggaccaccg gcagctccac gaattctcct ccccttctca tctcctgcgg
1621 accccaagca gtgcctctac agtcagtgtg ggctccagtg agacccgggg tgagcgtgtt
1681 attgatgctg tgcgattcac cctccgccag accatctctt tcccaccccg agatgagtgg
1741 aatgacttca actttgacat ggatgctcgc cgcaataagc aacagcgcat caaagaggag
1801 ggggagtgag cctcaccatg tgagctcttc ctatccctct cctaactgcc agccccctaa
1861 aagcactcct gcttaatctt caaagccttc tccctagctc ctccccttcc tcttgtctga
1921 tttcttaggg gaaggagaag taagaggcta cctcttacct aacatctgac ctggcatcta
1981 attctgattc tggctttaag ccttcaaaac tatagcttgc agaactgtag ctgccatggc
2041 taggtagaag tgagcaaaaa agagttgggt gtctccttaa gctgcagaga tttctcattg
2101 acttttataa agcatgttca cccttatagt ctaagactat atatataaat gtataaatat
2161 acagtataga tttttgggtg gggggcattg agtattgttt aaaatgtaat ttaaatgaaa
2221 gaaaattgag ttgcacttat tgaccatttt ttaatttact tgttttggat ggcttgtcta
2281 tactccttcc cttaaggggt atcatgtatg gtgataggta tctagagctt aatgctacat
2341 gtgagtgacg atgatgtaca gattctttca gttctttgga ttctaaatac atgccacatc
2401 aaacctttga gtagatccat ttccattgct tattatgtag gtaagactgt agatatgtat
2461 tcttttctca gtgttggtat attttatatt actgacattt cttctagtga tgatggttca
2521 cgttggggtg atttaatcca gttataagaa gaagttcatg tccaaacgtc ctctttagtt
2581 tttggttggg aatgaggaaa attcttaaaa ggcccatagc agccagttca aaaacacccg
2641 acgtcatgta tttgagcata tcagtaaccc ccttaaattt aataccagat accttatctt
2701 acaatattga ttgggaaaac atttgctgcc attacagagg tattaaaact aaatttcact
2761 actagattga ctaactcaaa tacacatttg ctactgttgt aagaattctg attgatttga
2821 ttgggatgaa tgccatctat ctagttctaa cagtgaagtt ttactgtcta ttaatattca
```

TABLE 1-continued

```
2881 gggtaaatag gaatcattca gaaatgttga gtctgtacta aacagtaaga tatctcaatg
2941 aaccataaat tcaactttgt aaaaatcttt tgaagcatag ataatattgt ttggtaaatg
3001 tttcttttgt ttggtaaatg tttcttttaa agaccctcct attctataaa actctgcatg
3061 tagaggcttg tttacctttc tctctctaag gtttacaata ggagtggtga tttgaaaaat
3121 ataaaattat gagattggtt ttcctgtggc ataaattgca tcactgtatc attttctttt
3181 ttaaccggta agagtttcag tttgttggaa agtaactgtg agaacccagt ttcccgtcca
3241 tctcccttag ggactaccca tagacatgaa aggtccccac agagcaagag ataagtcttt
3301 catggctgct gttgcttaaa ccacttaaac gaagagttcc cttgaaactt tgggaaaaca
3361 tgttaatgac aatattccag atctttcaga aatataacac attttttgc atgcatgcaa
3421 atgagctctg aaatcttccc atgcattctg gtcaagggct gtcattgcac ataagcttcc
3481 atttaattt taaagtgcaa aagggccagc gtggctctaa aaggtaatgt gtggattgcc
3541 tctgaaaagt gtgtatatat tttgtgtgaa attgcatact ttgtattttg attattttt
3601 ttttcttctt gggatagtgg gatttccaga accacacttg aaaccttttt ttatcgtttt
3661 tgtattttca tgaaaatacc atttagtaag aataccacat caaataagaa ataatgctac
3721 aattttaaga ggggagggaa gggaaagttt tttttatta tttttttaaa attttgtatg
3781 ttaaagagaa tgagtccttg atttcaaagt tttgttgtac ttaaatggta ataagcactg
3841 taaacttctg caacaagcat gcagctttgc aaacccatta aggggaagaa tgaaagctgt
3901 tccttggtcc tagtaagaag acaaactgct tcccttactt tgctgagggt ttgaataaac
3961 ctaggacttc cgagctatgt cagtactatt caggtaacac tagggccttg gaaattcctg
4021 tactgtgtct catggatttg gcactagcca aagcgaggca cccttactgg cttacctcct
4081 catggcagcc tactctcctt gagtgtatga gtagccaggg taaggggtaa aaggatagta
4141 agcatagaaa ccactagaaa gtgggcttaa tggagttctt gtggcctcag ctcaatgcag
4201 ttagctgaag aattgaaaag tttttgtttg gagacgttta taaacagaaa tggaaagcag
4261 agttttcatt aaatcctttt accttttttt tttcttggta atcccctaaa ataacagtat
4321 gtgggatatt gaatgttaaa gggatatttt tttctattat ttttataatt gtacaaaatt
4381 aagcaaatgt taaaagtttt atatgcttta ttaatgtttt caaaaggtat tatacatgtg
4441 atacattttt taagcttcag ttgcttgtct tctggtactt tctgttatgg gcttttgggg
4501 agccagaagc caatctacaa tctcttttg tttgccagga catgcaataa aatttaaaaa
4561 ataaataaaa actaattaag aaa
```

SEQ ID NO: 26 Human p63 Isoform 5 Amino Acid Sequence (NP_001108453.1)

```
  1 mlylennaqt qfsepqytnl gllnsmdqqi qngsssтspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgteftttvly nfmcnsscvg gmnrrpilii vtletrdgqv
241 lgrrcfeari cacpgrdrka dedsirkqqv sdstkngdgt krpfrqnthg iqmtsikkrr
301 spddellylp vrgretyeml lkikeslelm qylpqhtiet yrqqqqqhq hllqkqtsiq
361 spssygnssp plnkmnsmnk lpsysqlinp qqrnaltptt ipdgmganip mmgthmpmag
421 dmnglsptqa lppplsmpst shctppppyp tdcsivriwq v
```

SEQ ID NO: 27 Human p63 transcript variant 6 mRNA Sequence
(NM_001114982.2; CDS: 143-1324)

```
   1 cagagagaga aagagagaga gggacttgag ttctgttatc ttcttaagta gattcatatt
  61 gtaagggtct cggggtgggg gggttggcaa aatcctggag ccagaagaaa ggacagcagc
 121 attgatcaat cttacagcta acatgttgta cctggaaaac aatgcccaga ctcaatttag
 181 tgagccacag tacacgaacc tggggctcct gaacagcatg gaccagcaga ttcagaacgg
 241 ctcctcgtcc accagtccct ataacacaga ccacgcgcag aacagcgtca cggcgccctc
 301 gccctacgca cagcccagct ccaccttcga tgctctctct ccatcacccg ccatcccctc
 361 caacaccgac tacccaggcc cgcacagttt cgacgtgtcc ttccagcagt cgagcaccgc
 421 caagtcggcc acctggacgt attccactga actgaagaaa ctctactgcc aaattgcaaa
 481 gacatgcccc atccagatca aggtgatgac cccacctcct cagggagctg ttatccgcgc
 541 catgcctgtc tacaaaaaag ctgagcacgt cacggaggtg gtgaagcggt gccccaacca
 601 tgagctgagc cgtgaattca acgagggaca gattgcccct cctagtcatt tgattcgagt
 661 agaggggaac agccatgccc agtatgtaga agatcccatc acaggaagac agagtgtgct
 721 ggtaccttat gagccacccc aggttggcac tgaattcacg acagtcttgt acaatttcat
 781 gtgtaacagc agttgtgttg gagggatgaa ccgccgtcca attttaatca ttgttactct
 841 ggaaaccaga gatgggcaag tcctgggccg acgctgcttt gaggcccgga tctgtgcttg
 901 cccaggaaga gacaggaagg cggatgaaga tagcatcaga aagcagcaag tttcggacag
 961 tacaaagaac ggtgatggta cgaagcgccc gtttcgtcag aacacacatg gtatccagat
1021 gacatccatc aagaaacgaa gatccccaga tgatgaactg ttatacttac cagtgagggg
1081 ccgtgagact tatgaaatgc tgttgaagat caaagagtcc ctggaactca tgcagtacct
1141 tcctcagcac acaattgaaa cgtacaggca acagcaacag cagcagcacc agcacttact
1201 tcagaaacat ctcctttcag cctgcttcag gaatgagctt gtggagcccc ggagagaaac
1261 tccaaaacaa tctgacgtct tctttagaca ttccaagccc ccaaaccgat cagtgtaccc
1321 atagagccct atctctatat tttaagtgtg tgtgttgtat ttccatgtgt atatgtgagt
1381 gtgtgtgtgt gtatgtgtgt gcgtgtgtat ctagccctca taaacaggac ttgaagacac
1441 tttggctcag agacccaact gctcaaaggc acaaagccac tagtgagaga atcttttgaa
1501 gggactcaaa cctttacaag aaaggatgtt ttctgcagat tttgtatcct tagaccggcc
1561 attggtgggt gaggaaccac tgtgtttgtc tgtgagcttt ctgttgtttc ctgggaggga
1621 ggggtcaggt ggggaaaggg gcattaagat gtttattgga acccttttct gtcttcttct
1681 gttgtttttc taaaattcac agggaagctt ttgagcaggt ctcaaactta agatgtcttt
1741 ttaagaaaag gagaaaaaag ttgttattgt ctgtgcataa gtaagttgta ggtgactgag
1801 agactcagtc agaccctttt aatgctggtc atgtaataat attgcaagta gtaagaaacg
1861 aaggtgtcaa gtgtactgct gggcagcgag gtgatcatta ccaaaagtaa tcaactttgt
1921 gggtggagag ttctttgtga gaacttgcat tatttgtgtc ctcccctcat gtgtaggtag
1981 aacatttctt aatgctgtgt acctgcctct gccactgtat gttggcatct gttatgctaa
2041 agtttttctt gtacatgaaa ccctggaaga cctactacaa aaaaactgtt gtttggcccc
2101 catagcaggt gaactcattt tgtgctttta atagaaagac aaatccaccc cagtaatatt
2161 gcccttacgt agttgtttac cattattcaa agctcaaaat agaatttgaa gccctctcac
2221 aaaatctgtg attaatttgc ttaattagag cttctatccc tcaagcctac ctaccataaa
```

TABLE 1-continued

```
2281 accagccata ttactgatac tgttcagtgc atttagccag gagacttacg ttttgagtaa
2341 gtgagatcca agcagacgtg ttaaaatcag cactcctgga ctggaaatta aagattgaaa
2401 gggtagacta cttttctttt ttttactcaa aagtttagag aatctctgtt tctttccatt
2461 ttaaaaacat attttaagat aatagcataa agactttaaa aatgttcctc ccctccatct
2521 tcccacaccc agtcaccagc actgtatttt ctgtcaccaa gacaatgatt tcttgttatt
2581 gaggctgttg cttttgtgga tgtgtgattt taattttcaa taaacttttg catcttggtt
2641 tatcttgca
```

SEQ ID NO: 28 Human p63 Isoform 6 Sequence (NP_001108454.1)

```
  1 mlylennaqt qfsepqytnl gllnsmdqql qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdstkngdgt krpfrqnthg iqmtsikkrr
301 spddellylp vrgretyeml lkikeslelm qylpqhtiet yrqqqqqhq hllqkhllsa
361 cfrnelvepr retpkqsdvf frhskppnrs vyp
```

SEQ ID NO: 29 Human p63 transcript variant 7 mRNA Sequence (NM_001329144.2; CDS: 128-1660)

```
   1 ctatgtctga tagcatttga ccctattgct tttagcctcc cggctttata tctatatata
  61 cacaggtata tgtgtatatt ttatataatt gttctccgtt cgttgatatc aaagacagtt
 121 gaaggaaatg aattttgaaa cttcacggtg tgccacccta cagtactgcc ctgaccctta
 181 catccagcgt ttcgtagaaa ccccagctca tttctcttgg aaagaaagtt attaccgatc
 241 caccatgtcc cagagcacac agacaaatga attcctcagt ccagaggttt tccagcatat
 301 ctgggatttt ctggaacagc ctatatgttc agttcagccc attgacttga actttgtgga
 361 tgaaccatca gaagatggtg cgacaaacaa gattgagatt agcatggact gtatccgcat
 421 gcaggactcg gacctgagtg accccatgtg gccacagtac acgaacctgg ggctcctgaa
 481 cagcatggac cagcagattc agaacggctc ctcgtccacc agtccctata acacagacca
 541 cgcgcagaac agcgtcacgg cgccctcgcc ctacgcacag cccagctcca ccttcgatgc
 601 tctctctcca tcacccgcca tcccctccaa caccgactac ccaggcccgc acagtttcga
 661 cgtgtccttc cagcagtcga gcaccgccaa gtcggccacc tggacgtatt ccactgaact
 721 gaagaaactc tactgccaaa ttgcaaagac atgccccatc cagatcaagg tgatgacccc
 781 acctcctcag ggagctgtta tccgcgccat gcctgtctac aaaaaagctg agcacgtcac
 841 ggaggtggtg aagcggtgcc ccaaccatga gctgagccgt gaattcaacg agggacagat
 901 tgcccctcct agtcatttga ttcgagtaga ggggaacagc catgcccagt atgtagaaga
 961 tcccatcaca ggaagacaga gtgtgctggt accttatgag ccaccccagg ttggcactga
1021 attcacgaca gtcttgtaca atttcatgtg taacagcagt tgtgttggag ggatgaaccg
1081 ccgtccaatt ttaatcattg ttactctgga aaccagagat gggcaagtcc tgggccgacg
1141 ctgctttgag gcccggatct gtgcttgccc aggaagagac aggaaggcgg atgaagatag
1201 catcagaaag cagcaagttt cggacagtac aaagaacggt gatggtacga agcgcccgtt
1261 tcgtcagaac acacatggta tccagatgac atccatcaag aaacgaagat ccccagatga
1321 tgaactgtta tacttaccag tgagggggcg tgagacttat gaaatgctgt tgaagatcaa
1381 agagtccctg gaactcatgc agtaccttcc tcagcacaca attgaaacgt acaggcaaca
1441 gcaacagcag cagcaccagc acttacttca gaaacagacc tcaatacagt ctccatcttc
1501 atatggtaac agctccccac ctctgaacaa aatgaacagc atgaacaagc tgccttctgt
1561 gagccagctt atcaaccctc agcagcgcaa cgccctcact cctacaacca ttcctgatgg
1621 catgggagcc aacagatctg gcaagtctga aaatccctga gcaatttcga catgcgatct
1681 ggaagggcat cctggaccac cggcagctcc acgaattctc ctccccttct catctcctgc
1741 ggaccccaag cagtgcctct acagtcagtg tgggctccag tgagacccgg ggtgagcgtg
1801 ttattgatgc tgtgcgattc accctccgcc agaccatctc tttcccaccc cgagatgagt
1861 ggaatgactt caactttgac atggatgctc gccgcaataa gcaacagcgc atcaaagagg
1921 aggggggagtg agcctcacca tgtgagctct tcctatccct ctcctaactg ccagcccccct
1981 aaaagcactc ctgcttaatc ttcaaagcct tctccctagc tcctcccctt cctcttgtct
2041 gatttcttag gggaaggaga agtaagaggc tacctcttac ctaacatctg acctggcatc
2101 taattctgat tctggcttta agccttcaaa actatagctt gcagaactgt agctgccatg
2161 gctaggtaga agtgagcaaa aaagagttgg gtgtctcctt aagctgcaga gatttctcat
2221 tgacttttat aaagcatgtt caccttata gtctaagact atatatataa atgtataaat
2281 atacagtata gatttttggg tgggggcat tgagtattgt ttaaaatgta atttaaatga
2341 aagaaaattg agttgcactt attgaccatt ttttaattta cttgttttgg atggcttgtc
2401 tatactcctt cccttaaggg gtatcatgta tggtgatagg tatctagagc ttaatgctac
2461 atgtgagtga cgatgatgta cagattcttt cagttctttg gattctaaat acatgccaca
2521 tcaaaccttt gagtagatcc atttccattg cttattatgt aggtaagact gtagatatgt
2581 attcttttct cagtgttggt atattttata ttactgacat ttcttctagt gatgatggtt
2641 cacgttgggg tgatttaatc cagttataag aagaagttca tgtccaaacg tcctctttag
2701 tttttggttg ggaatgagga aaattcttaa aaggcccata gcagccagtt caaaaacacc
2761 cgacgtcatg tatttgagca tatcagtaac cccttaaat ttaataccag ataccttatc
2821 ttacaatatt gattgggaaa acatttgctg ccattacaga ggtattaaaa ctaaatttca
2881 ctactagatt gactaactca aatacacatt tgctactgtt gtaagaattc tgattgattt
2941 gattgggatg aatgccatct atctagttct aacagtgaag ttttactgtc tattaatatt
3001 cagggtaaat aggaatcatt cagaaatgtt gagtctgtac taaacagtaa gatatctcaa
3061 tgaaccataa attcaacttt gtaaaaatct tttgaagcat agataatatt gtttggtaaa
3121 tgtttctttt gtttggtaaa tgtttctttt aaagaccctc ctattctata aaactctgca
3181 tgtagaggct tgtttacctt tctctctcta aggtttacaa taggagtggt gatttgaaaa
3241 atataaaatt atgagattgg ttttcctgtg gcataaattg catcactgta tcattttctt
3301 ttttaaccgg taagagtttc agtttgttgg aaagtaactg tgagaaccca gtttcccgtc
3361 catctccctt agggactacc catagacatg aaaggtcccc acagagcaag agataagtct
3421 ttcatggctg ctgttgctta aaccacttaa acgaagagtt cccttgaaac tttgggaaaa
3481 catgttaatg acaatattcc agatctttca gaaatataac acattttttt gcatgcatgc
3541 aaatgagctc tgaaatcttc ccatgcattc tggtcaaggg ctgtcattgc acataagctt
3601 ccattttaat tttaaagtgc aaaagggcca gcgtggctct aaaaggtaat gtgtggattg
```

TABLE 1-continued

```
3661 cctctgaaaa gtgtgtatat attttgtgtg aaattgcata ctttgtattt tgattatttt
3721 tttttcttc ttgggatagt gggatttcca gaaccacact tgaaaccttt ttttatcgtt
3781 tttgtatttt catgaaaata ccatttagta agaataccac atcaaataag aaataatgct
3841 acaattttaa gaggggaggg aagggaaagt ttttttttat tattttttta aaattttgta
3901 tgttaaagag aatgagtcct tgatttcaaa gttttgttgt acttaaatgg taataagcac
3961 tgtaaacttc tgcaacaagc atgcagcttt gcaaacccat taaggggaag aatgaaagct
4021 gttccttggt cctagtaaga agacaaactg cttcccttac tttgctgagg gtttgaataa
4081 acctaggact tccgagctat gtcagtacta ttcaggtaac actagggcct tggaaattcc
4141 tgtactgtgt ctcatggatt tggcactagc caaagcgagg caccccttact ggcttacctc
4201 ctcatggcag cctactctcc ttgagtgtat gagtagccag ggtaaggggt aaaaggatag
4261 taagcataga aaccactaga aagtgggctt aatggagttc ttgtggcctc agctcaatgc
4321 agttagctga agaattgaaa agtttttgtt tggagacgtt tataaacaga aatggaaagc
4381 agagttttca ttaaatcctt ttaccttttt tttttcttgg taatccccta aaataacagt
4441 atgtgggata ttgaatgtta aagggatatt tttttctatt atttttataa ttgtacaaaa
4501 ttaagcaaat gttaaaagtt ttatatgctt tattaatgtt ttcaaaaggt attatacatg
4561 tgatacattt tttaagcttc agttgcttgt cttctggtac tttctgttat gggcttttgg
4621 ggagccagaa gccaatctac aatctctttt tgtttgccag gacatgcaat aaaatttaaa
4681 aaataaataa aaactaatta agaaa
```

SEQ ID NO: 30 Human p63 Isoform 7 Amino Acid Sequence (NP_001316073.1)

```
  1 mnfetsrcat lqycpdpyiq rfvetpahfs wkesyyrstm sqstqtnefl spevfqhiwd
 61 fleqpicsvq pidlnfvdep sedgatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdstkn gdgtkrpfrq nthgiqmtsi kkrrspddel lylpvrgret yemllkikes
421 lelmqylpqh tietyrqqqq qqhqhllqkq tsiqspssyg nssppinkmn smnklpsvsq
481 linpqqrnal tpttipdgmg anrsgksenp
```

SEQ ID NO: 31 Human p63 transcript variant 8 mRNA Sequence (NM_001329145.2; CDS: 143-1393)

```
   1 cagagagaga aagagagaga gggacttgag ttctgttatc ttcttaagta gattcatatt
  61 gtaagggtct cggggtgggg gggttggcaa aatcctggag ccagaagaaa ggacagcagc
 121 attgatcaat cttacagcta acatgttgta cctggaaaac aatgcccaga ctcaatttag
 181 tgagccacag tacacgaacc tggggctcct gaacagcatg gaccagcaga ttcagaacgg
 241 ctcctcgtcc accagtccct ataacacaga ccacgcgcag aacagcgtca cggcgccctc
 301 gccctacgca cagcccagct ccaccttcga tgctctctct ccatcacccg ccatcccctc
 361 caacaccgac tacccaggcc cgcacagttt cgacgtgtcc ttccagcagt cgagcaccgc
 421 caagtcggcc acctggacgt attccactga actgaagaaa ctctactgcc aaattgcaaa
 481 gacatgcccc atccagatca aggtgatgac cccacctcct cagggagctg ttatccgcgc
 541 catgcctgtc tacaaaaaag ctgagcacgt cacggaggtg gtgaagcggt gccccaacca
 601 tgagctgagc cgtgaattca acgagggaca gattgcccct cctagtcatt tgattcgagt
 661 agaggggaac agccatgccc agtatgtaga agatcccatc acaggaagac agagtgtgct
 721 ggtaccttat gagccacccc aggttggcac tgaattcacg acagtcttgt acaatttcat
 781 gtgtaacagc agttgtgttg gagggatgaa ccgccgtcca attttaatca ttgttactct
 841 ggaaaccaga gatgggcaag tcctgggccg acgctgcttt gaggcccgga tctgtgcttg
 901 cccaggaaga gacaggaagg cggatgaaga tagcatcaga aagcagcaag tttcggacag
 961 tacaaagaac ggtgatggta cgaagcgccc gtttcgtcag aacacacatg gtatccagat
1021 gacatccatc aagaaacgaa gatccccaga tgatgaactg ttatacttac cagtgagggg
1081 ccgtgagact tatgaaatgc tgttgaagat caaagagtcc ctggaactca tgcagtacct
1141 tcctcagcac acaattgaaa cgtacaggca acagcaacag cagcagcacc agcacttact
1201 tcagaaacag acctcaatac agtctccatc ttcatatggt aacagctccc cacctctgaa
1261 caaaatgaac agcatgaaca agctgccttc tgtgagccag cttatcaacc ctcagcagcg
1321 caacgccctc actcctacaa ccattcctga tggcatggga gccaacagat ctggcaagtc
1381 tgaaaatccc tgagcaattt cgacatgcga tctggaaggg catcctggac caccggcagc
1441 tccacgaatt ctcctcccct tctcatctcc tgcggacccc aagcagtgcc tctacagtca
1501 gtgtgggctc cagtgagacc cggggtgagc gtgttattga tgctgtgcga ttcaccctcc
1561 gccagaccat ctctttccca ccccgagatg agtggaatga cttcaacttt gacatggatg
1621 ctcgccgcaa taagcaacag cgcatcaaag aggaggggga gtgagcctca ccatgtgagc
1681 tcttcctatc cctctcctaa ctgccagccc cctaaaagca ctcctgctta atcttcaaag
1741 ccttctccct agctcctccc cttcctcttg tctgatttct taggggaagg agaagtaaga
1801 ggctacctct tacctaacat ctgacctggc atctaattct gattctggct ttaagccttc
1861 aaaactatag cttgcagaac tgtagctgcc atggctaggt agaagtgagc aaaaaagagt
1921 tgggtgtctc cttaagctgc agagatttct cattgacttt tataaagcat gttcaccctt
1981 atagtctaag actatatata taaatgtata aatatacagt atagattttt gggtgggggg
2041 cattgagtat tgtttaaaat gtaatttaaa tgaaagaaaa ttgagttgca cttattgacc
2101 attttttaat ttacttgttt tggatggctt gtctatactc cttcccttaa ggggtatcat
2161 gtatggtgat aggtatctag agcttaatgc tacatgtgag tgacgatgat gtacagattc
2221 tttcagttct ttggattcta aatacatgcc acatcaaacc tttgagtaga tccatttcca
2281 ttgcttatta tgtaggtaag actgtagata tgtattcttt tctcagtgtt ggtatatttt
2341 atattactga catttcttct agtgatgatg gttcacgttg ggtgatttta atccagttat
2401 aagaagaagt tcatgtccaa acgtcctctt tagtttttgg ttgggaatga ggaaaattct
2461 taaaaggccc atagcagcca gttcaaaaac acccgacgtc atgtatttga gcatatcagt
2521 aacccccctta aatttaatac cagatacctt atcttacaat attgattggg aaaacatttg
2581 ctgccattac agaggtatta aaactaaatt tcactactag attgactaac tcaaatacac
2641 atttgctact gttgtaagaa ttctgattga tttgattggg atgaatgcca tctatctagt
2701 tctaacagtg aagttttact gtctattaat attcagggta aataggaatc attcagaaat
2761 gttgagtctg tactaaacag taagatatct caatgaacca taaattcaac tttgtaaaaa
2821 tcttttgaag catagataat attgtttggt aaatgtttct tttgtttggt aaatgtttct
```

TABLE 1-continued

```
2881 tttaaagacc ctcctattct ataaaactct gcatgtagag gcttgtttac ctttctctct
2941 ctaaggttta caataggagt ggtgatttga aaaatataaa attatgagat tggttttcct
3001 gtggcataaa ttgcatcact gtatcatttt cttttttaac cggtaagagt ttcagtttgt
3061 tggaaagtaa ctgtgagaac ccagtttccc gtccatctcc cttagggact acccatagac
3121 atgaaaggtc cccacagagc aagagataag tctttcatgg ctgctgttgc ttaaaccact
3181 taaacgaaga gttcccttga aactttggga aaacatgtta atgacaatat tccagatctt
3241 tcagaaatat aacacatttt tttgcatgca tgcaaatgag ctctgaaatc ttcccatgca
3301 ttctggtcaa gggctgtcat tgcacataag cttccatttt aattttaaag tgcaaaaggg
3361 ccagcgtggc tctaaaaggt aatgtgtgga ttgcctctga aaagtgtgta tatattttgt
3421 gtgaaattgc atactttgta ttttgattat tttttttttc ttcttgggat agtgggattt
3481 ccagaaccac acttgaaacc tttttttatc gtttttgtat tttcatgaaa ataccattta
3541 gtaagaatac cacatcaaat aagaaataat gctacaattt taagagggga gggaagggaa
3601 agttttttttt tattattttt ttaaaatttt gtatgttaaa gagaatgagt ccttgatttc
3661 aaagttttgt tgtacttaaa tggtaataag cactgtaaac ttctgcaaca agcatgcagc
3721 tttgcaaacc cattaagggg aagaatgaaa gctgttcctt ggtcctagta agaagacaaa
3781 ctgcttccct tactttgctg agggtttgaa taaacctagg acttccgagc tatgtcagta
3841 ctattcaggt aacactaggg ccttggaaat tcctgtactg tgtctcatgg atttggcact
3901 agccaaagcg aggcaccctt actggcttac ctcctcatgg cagcctactc tccttgagtg
3961 tatgagtagc cagggtaagg ggtaaaagga tagtaagcat agaaaccact agaaagtggg
4021 cttaatggag ttcttgtggc ctcagctcaa tgcagttagc tgaagaattg aaaagttttt
4081 gtttggagac gtttataaac agaaatggaa agcagagttt tcattaaatc cttttacctt
4141 ttttttttct tggtaatccc ctaaaataac agtatgtggg atattgaatg ttaaagggat
4201 attttttttct attattttta taattgtaca aaattaagca aatgttaaaa gttttatatg
4261 ctttattaat gttttcaaaa ggtattatac atgtgataca tttttaagc ttcagttgct
4321 tgtcttctgg tactttctgt tatgggcttt tggggagcca gaagccaatc tacaatctct
4381 ttttgtttgc caggacatgc aataaaattt aaaaaataaa taaaaactaa ttaagaaa
```

SEQ ID NO: 32 Human p63 Isoform 8 Amino Acid Sequence (NP_001316074.1)

```
  1 mlylennaqt qfsepqytnl gllnsmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgteftvly nfmcnsscvg gmnrrpilii vtletrdgqv
241 lgrrcfeari cacpgrdrka dedsirkqqv sdstkngdgt krpfrqnthg iqmtsikkrr
301 spddellylp vrgretyeml lkikeslelm qylpqhtiet yrqqqqqqhq hllqkqtsiq
361 spssygnssp pinkmnsmnk lpsvsqlinp qqrnaltptt ipdgmganrs gksenp
```

SEQ ID NO: 33 Human p63 transcript variant 9 mRNA Sequence NM_001329146.2; CDS: 143-1648)

```
   1 cagagagaga aagagagaga gggacttgag ttctgttatc ttcttaagta gattcatatt
  61 gtaagggtct cggggtgggg gggttggcaa aatcctggag ccagaagaaa ggacagcagc
 121 attgatcaat cttacagcta acatgttgta cctggaaaac aatgcccaga ctcaatttag
 181 tgagtattcc actgaactga agaaactcta ctgccaaatt gcaaagacat gccccatcca
 241 gatcaaggtg atgaccccac ctcctcaggg agctgttatc cgcgccatgc ctgtctacaa
 301 aaaagctgag cacgtcacgg aggtggtgaa gcggtgcccc aaccatgagc tgagccgtga
 361 attcaacgag ggacagattg cccctcctag tcatttgatt cgagtagagg ggaacagcca
 421 tgcccagtat gtagaagatc ccatcacagg aagacagagt gtgctggtac cttatgagcc
 481 accccaggtt ggcactgaat tcacgacagt cttgtacaat ttcatgtgta acagcagttg
 541 tgttggaggg atgaaccgcc gtccaatttt aatcattgtt actctggaaa ccagagatgg
 601 gcaagtcctg ggccgacgct gctttgaggc ccggatctgt gcttgcccag gaagagacag
 661 gaaggcggat gaagatagca tcagaaagca gcaagtttcg gacagtacaa agaacggtga
 721 tggtacgaag cgcccgtttc gtcagaacac acatggtatc cagatgacat ccatcaagaa
 781 acgaagatcc ccagatgatg aactgttata cttaccagtg aggggccgtg agacttatga
 841 aatgctgttg aagatcaaag agtccctgga actcatgcag taccttcctc agcacacaat
 901 tgaaacgtac aggcaacagc aacagcagca gcaccagcac ttacttcaga aacagacctc
 961 aatacagtct ccatcttcat atggtaacag ctccccacct ctgaacaaaa tgaacagcat
1021 gaacaagctg ccttctgtga gccagcttat caaccctcag cagcgcaacg ccctcactcc
1081 tacaaccatt cctgatggca tgggagccaa cattcccatg atgggcaccc acatgccaat
1141 ggctggagac atgaatggac tcagccccac ccaggcactc cctcccccac tctccatgcc
1201 atccacctcc cactgcacac ccccacctcc gtatcccaca gattgcagca ttgtcagttt
1261 cttagcgagg ttgggctgtt catcatgtct ggactatttc acgacccagg ggctgaccac
1321 catctatcag attgagcatt actccatgga tgatctggca agtctgaaaa tccctgagca
1381 atttcgacat gcgatctgga agggcatcct ggaccaccgg cagctccacg aattctcctc
1441 cccttctcat ctcctgcgga ccccaagcag tgcctctaca gtcagtgtgg gctccagtga
1501 gacccggggt gagcgtgtta ttgatgctgt gcgattcacc ctccgccaga ccatctcttt
1561 cccacccga gatgagtgga atgacttcaa ctttgacatg gatgctcgcc gcaataagca
1621 acagcgcatc aaagaggagg gggagtgagc ctcaccatgt gagctcttcc tatccctctc
1681 ctaactgcca gccccctaaa agcactcctg cttaatcttc aaagccttct ccctagctcc
1741 tccccttcct cttgtctgat ttcttagggg aaggagaagt aagaggctac ctcttaccta
1801 acatctgacc tggcatctaa ttctgattct ggctttaagc cttcaaaact atagcttgca
1861 gaactgtagc tgccatggct aggtagaagt gagcaaaaaa gagttgggtg tctccttaag
1921 ctgcagagat ttctcattga cttttataaa gcatgttcac ccttatagtc taagactata
1981 tatataaatg tataaatata cagtatagat ttttgggtgg ggggcattga gtattgttta
2041 aaatgtaatt taaatgaaag aaaattgagt tgcacttatt gaccattttt taatttactt
2101 gttttggatg gcttgtctat actccttccc ttaaggggta tcatgtatgg tgataggtat
2161 ctagagctta atgctacatg tgagtgacga tgatgtacag attctttcag ttctttggat
2221 tctaaataca tgccacatca aacctttgag tagatccatt tccattgctt attatgtagg
2281 taagactgta gatatgtatt cttttctcag tgttggtata ttttatatta ctgacatttc
2341 ttctagtgat gatggttcac gttggggtga tttaatccag ttataagaag aagttcatgt
2401 ccaaacgtcc tctttagttt ttggttggga atgaggaaaa ttcttaaaag gcccatagca
2461 gccagttcaa aaacacccga cgtcatgtat ttgagcatat cagtaacccc cttaaattta
```

TABLE 1-continued

```
2521 ataccagata ccttatctta caatattgat tgggaaaaca tttgctgcca ttacagaggt
2581 attaaaacta aatttcacta ctagattgac taactcaaat acacatttgc tactgttgta
2641 agaattctga ttgatttgat tgggatgaat gccatctatc tagttctaac agtgaagttt
2701 tactgtctat taatattcag ggtaaatagg aatcattcag aaatgttgag tctgtactaa
2761 acagtaagat atctcaatga accataaatt caactttgta aaaatctttt gaagcataga
2821 taatattgtt tggtaaatgt ttcttttgtt tggtaaatgt ttcttttaaa gaccctccta
2881 ttctataaaa ctctgcatgt agaggcttgt ttacctttct ctctctaagg tttacaatag
2941 gagtggtgat ttgaaaaata taaaattatg agattggttt tcctgtggca taaattgcat
3001 cactgtatca ttttcttttt taaccggtaa gagtttcagt ttgttggaaa gtaactgtga
3061 gaacccagtt tcccgtccat ctcccttagg gactacccat agacatgaaa ggtccccaca
3121 gagcaagaga taagtctttc atggctgctg ttgcttaaac cacttaaacg aagagttccc
3181 ttgaaacttt gggaaaacat gttaatgaca atattccaga tctttcagaa atataacaca
3241 ttttttgca tgcatgcaaa tgagctctga aatcttccca tgcattctgg tcaagggctg
3301 tcattgcaca taagcttcca ttttaatttt aaagtgcaaa agggccagcg tggctctaaa
3361 aggtaatgtg tggattgcct ctgaaaagtg tgtatatatt ttgtgtgaaa ttgcatactt
3421 tgtattttga ttattttttt tttcttcttg ggatagtggg atttccagaa ccacacttga
3481 aacctttttt tatcgttttt gtattttcat gaaaatacca tttagtaaga ataccacatc
3541 aaataagaaa taatgctaca attttaagag gggagggaag ggaaagtttt tttttattat
3601 ttttttaaaa ttttgtatgt taaagagaat gagtccttga tttcaaagtt ttgttgtact
3661 taaatggtaa taagcactgt aaacttctgc aacaagcatg cagctttgca aacccattaa
3721 ggggaagaat gaaagctgtt ccttggtcct agtaagaaga caaactgctt cccttacttt
3781 gctgagggtt tgaataaacc taggacttcc gagctatgtc agtactattc aggtaacact
3841 agggccttgg aaattcctgt actgtgtctc atggatttgg cactagccaa agcgaggcac
3901 ccttactggc ttacctcctc atggcagcct actctccttg agtgtatgag tagccagggt
3961 aaggggtaaa aggatagtaa gcatagaaac cactagaaag tgggcttaat ggagttcttg
4021 tggcctcagc tcaatgcagt tagctgaaga attgaaaagt ttttgtttgg agacgtttat
4081 aaacagaaat ggaaagcaga gttttcatta aatcctttta ccttttttt ttcttggtaa
4141 tcccctaaaa taacagtatg tgggatattg aatgttaaag ggatattttt ttctattatt
4201 tttataattg tacaaaatta agcaaatgtt aaaagtttta tatgctttat taatgttttc
4261 aaaaggtatt atacatgtga tacatttttt aagcttcagt tgcttgtctt ctggtacttt
4321 ctgttatggg cttttgggga gccagaagcc aatctacaat ctctttttgt ttgccaggac
4381 atgcaataaa atttaaaaaa taaataaaaa ctaattaaga aa
```

SEQ ID NO: 34 Human p63 Isoform 9 Amino Acid Sequence (NP_001316075.1)

```
  1 mlylennaqt qfseystelk klycqiaktc piqikvmtpp pqgaviramp vykkaehvte
 61 vvkrcpnhel srefnegqia ppshlirveg nshaqyvedp itgrqsvlvp yeppqvgtef
121 ttvlynfmcn sscvggmnrr piliivtlet rdgqvlgrrc fearicacpg rdrkadedsi
181 rkqqvsdstk ngdgtkrpfr qnthgiqmts ikkrrspdde llylpvrgre tyemllkike
241 slelmqylpq htietyrqqq qqhqhllqk qtsiqspssy gnssppinkm nsmnklpsvs
301 qlinpqqrna ltpttipdgm ganipmmgth mpmagdmngl sptqalpppl smpstshctp
361 pppyptdcsi vsflarlgcs scldyfttqg lttiyqiehy smddlaslki peqfrhaiwk
421 gildhrqlhe fsspshllrt pssastvsvg ssetrgervi davrftlrqt isfpprdewn
481 dfnfdmdarr nkqqrikeeg e
```

SEQ ID NO: 35 Human p63 transcript variant 10 mRNA Sequence
NM_001329148.2; CDS: 128-2158)

```
   1 ctatgtctga tagcatttga ccctattgct tttagcctcc cggctttata tctatatata
  61 cacaggtata tgtgtatatt ttatataatt gttctccgtt cgttgatatc aaagacagtt
 121 gaaggaaatg aatttgaaa cttcacggtg tgccacccta cagtactgcc ctgaccctta
 181 catccagcgt ttcgtagaaa ccccagctca tttctcttgg aaagaaagtt attaccgatc
 241 caccatgtcc cagagcacac agacaaatga attcctcagt ccagaggttt tccagcatat
 301 ctgggatttt ctggaacagc ctatatgttc agttcagccc attgacttga actttgtgga
 361 tgaaccatca gaagatggtg cgacaaacaa gattgagatt agcatggact gtatccgcat
 421 gcaggactcg gacctgagtg accccatgtg gccacagtac acgaacctgg ggctcctgaa
 481 cagcatggac cagcagattc agaacggctc ctcgtccacc agtccctata acacagacca
 541 cgcgcagaac agcgtcacgg cgccctcgcc ctacgcacag cccagctcca ccttcgatgc
 601 tctctctcca tcacccgcca tcccctccaa caccgactac ccaggcccgc acagtttcga
 661 cgtgtccttc cagcagtcga gcaccgccaa gtcggccacc tggacgtatt ccactgaact
 721 gaagaaactc tactgccaaa ttgcaaagac atgccccatc cagatcaagg tgatgacccc
 781 acctcctcag ggagctgtta tccgcgccat gcctgtctac aaaaaagctg agcacgtcac
 841 ggaggtggtg aagcggtgcc ccaaccatga gctgagccgt gaattcaacg agggacagat
 901 tgcccctcct agtcatttga ttcgagtaga ggggaacagc catgcccagt atgtagaaga
 961 tcccatcaca ggaagacaga gtgtgctggt accttatgag ccaccccagg ttggcactga
1021 attcacgaca gtcttgtaca atttcatgtg taacagcagt tgtgttggag ggatgaaccg
1081 ccgtccaatt ttaatcattg ttactctgga aaccagagat gggcaagtcc tgggccgacg
1141 ctgctttgag gcccggatct gtgcttgccc aggaagagac aggaaggcgg atgaagatag
1201 catcagaaag cagcaagttt cggacagtac aaagaacggt gatgcgtttc gtcagaacac
1261 acatggtatc cagatgacat ccatcaagaa acgaagatcc ccagatgatg aactgttata
1321 cttaccagtg aggggccgtg agacttatga aatgctgttg aagatcaaag agtccctgga
1381 actcatgcag taccttcctc agcacacaat tgaaacgtac aggcaacagc aacagcagca
1441 gcaccagcac ttacttcaga aacagacctc aatacagtct ccatcttcat atggtaacag
1501 ctccccacct ctgaacaaaa tgaacagcat gaacaagctg ccttctgtga gccagcttat
1561 caaccctcag cagcgcaacg ccctcactcc tacaaccatt cctgatggca tgggagccaa
1621 cattcccatg atgggcaccc acatgccaat ggctggagac atgaatggac tcagccccac
1681 ccaggcactc cctcccccac tctccatgcc atccacctcc cactgcacac ccccacctcc
1741 gtatcccaca gattgcagca ttgtcagttt cttagcgagg ttgggctgtt catcatgtct
1801 ggactatttc acgacccagg ggctgaccac catctatcag attgagcatt actccatgga
1861 tgatctggca agtctgaaaa tccctgagca atttcgacat gcgatctgga agggcatcct
1921 ggaccaccgg cagctccacg aattctcctc cccttctcat ctcctgcgga ccccaagcag
1981 tgcctctaca gtcagtgtgg gctccagtga gacccggggt gagcgtgtta ttgatgctgt
```

TABLE 1-continued

```
2041 gcgattcacc ctccgccaga ccatctcttt cccaccccga gatgagtgga atgacttcaa
2101 ctttgacatg gatgctcgcc gcaataagca acagcgcatc aaagaggagg gggagtgagc
2161 ctcaccatgt gagctcttcc tatccctctc ctaactgcca gccccctaaa agcactcctg
2221 cttaatcttc aaagccttct ccctagctcc tcccctcct cttgtctgat ttcttagggg
2281 aaggagaagt aagaggctac ctcttaccta acatctgacc tggcatctaa ttctgattct
2341 ggctttaagc cttcaaaact atagcttgca gaactgtagc tgccatggct aggtagaagt
2401 gagcaaaaaa gagttgggtg tctccttaag ctgcagagat ttctcattga cttttataaa
2461 gcatgttcac ccttatagtc taagactata tatataaatg tataaatata cagtatagat
2521 ttttgggtgg ggggcattga gtattgttta aaatgtaatt taaatgaaag aaaattgagt
2581 tgcacttatt gaccattttt taatttactt gttttggatg gcttgtctat actccttccc
2641 ttaaggggta tcatgtatgg tgataggtat ctagagctta atgctacatg tgagtgacga
2701 tgatgtacag attctttcag ttctttggat tctaaataca tgccacatca aacctttgag
2761 tagatccatt tccattgctt attatgtagg taagactgta gatatgtatt cttttctcag
2821 tgttggtata ttttatatta ctgacatttc ttctagtgat gatggttcac gttggggtga
2881 tttaatccag ttataagaag aagttcatgt ccaaacgtcc tctttagttt ttggttggga
2941 atgaggaaaa ttcttaaaag gcccatagca gccagttcaa aaacacccga cgtcatgtat
3001 ttgagcatat cagtaacccc cttaaattta ataccagata ccttatctta caatattgat
3061 tgggaaaaca tttgctgcca ttacagaggt attaaaacta aatttcacta ctagattgac
3121 taactcaaat acacatttgc tactgttgta agaattctga ttgatttgat tgggatgaat
3181 gccatctatc tagttctaac agtgaagttt tactgtctat taatattcag ggtaaatagg
3241 aatcattcag aaatgttgag tctgtactaa acagtaagat atctcaatga accataaatt
3301 caactttgta aaaatctttt gaagcataga taatattgtt tggtaaatgt ttcttttgtt
3361 tggtaaatgt ttcttttaaa gaccctccta ttctataaaa ctctgcatgt agaggcttgt
3421 ttacctttct ctctctaagg tttacaatag gagtggtgat ttgaaaaata taaaattatg
3481 agattggttt tcctgtggca taaattgcat cactgtatca ttttcttttt taaccggtaa
3541 gagtttcagt ttgttggaaa gtaactgtga gaacccagtt tcccgtccat ctcccttagg
3601 gactacccat agacatgaaa ggtccccaca gagcaagaga taagtctttc atggctgctg
3661 ttgcttaaac cacttaaacg aagagttccc ttgaaacttt gggaaaacat gttaatgaca
3721 atattccaga tctttcagaa atataacaca ttttttgca tgcatgcaaa tgagctctga
3781 aatcttccca tgcattctgg tcaagggctg tcattgcaca taagcttcca ttttaatttt
3841 aaagtgcaaa agggccagcg tggctctaaa aggtaatgtg tggattgcct ctgaaaagtg
3901 tgtatatatt ttgtgtgaaa ttgcatactt tgtattttga ttattttttt tttcttcttg
3961 ggatagtggg atttccagaa ccacacttga aacctttttt tatcgttttt gtattttcat
4021 gaaaatacca tttagtaaga ataccacatc aaataagaaa taatgctaca attttaagag
4081 gggagggaag ggaaagtttt tttttattat ttttttaaaa ttttgtatgt taaagagaat
4141 gagtccttga tttcaaagtt ttgttgtact taaatggtaa taagcactgt aaacttctgc
4201 aacaagcatg cagctttgca aacccattaa ggggaagaat gaaagctgtt ccttggtcct
4261 agtaagaaga caaactgctt cccttacttt gctgagggtt tgaataaacc taggacttcc
4321 gagctatgtc agtactattc aggtaacact agggccttgg aaattcctgt actgtgtctc
4381 atggatttgg cactagccaa agcgaggcac ccttactggc ttacctcctc atggcagcct
4441 actctccttg agtgtatgag tagccagggt aaggggtaaa aggatagtaa gcatagaaac
4501 cactagaaag tgggcttaat ggagttcttg tggcctcagc tcaatgcagt tagctgaaga
4561 attgaaaagt ttttgtttgg agacgtttat aaacagaaat ggaaagcaga gttttcatta
4621 aatcctttta ccttttttt ttcttggtaa tcccctaaaa taacagtatg tgggatattg
4681 aatgttaaag ggatattttt ttctattatt tttataattg tacaaaatta agcaaatgtt
4741 aaaagtttta tatgctttat taatgttttc aaaaggtatt atacatgtga tacattttt
4801 aagcttcagt tgcttgtctt ctggtacttt ctgttatggg cttttgggga gccagaagcc
4861 aatctacaat ctctttttgt ttgccaggac atgcaataaa atttaaaaaa taaataaaaa
4921 ctaattaaga aa
```

SEQ ID NO: 36 Human p63 Isoform 10 Amino Acid Sequence (NP_001316077.1)

```
  1 mnfetsrcat lqycpdpyiq rfvetpahfs wkesyyrstm sqstqtnefl spevfqhiwd
 61 fleqpicsvq pidlnfvdep sedgatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdstkn gdafrqnthg iqmtsikkrr spddellylp vrgretyeml lkikeslelm
421 qylpqhtiet yrqqqqqhq hllqkqtsiq spssygnssp plnkmnsmnk lpsvsqlinp
481 qqrnaltptt ipdgmganip mmgthmpmag dmnglsptqa lppplsmpst shctppppyp
541 tdcsivsfla rlgcsscldy fttqglttiy qiehysmddl aslkipeqfr haiwkgildh
601 rqlhefssps hllrtpssas tvsvgsssetr gervidavrf tlrqtisfpp rdewndfnfd
661 mdarrnkqqr ikeege
```

SEQ ID NO: 37 Human p63 transcript variant 11 (NM_001329149.2; CDS: 143-1381) mRNA Sequence

```
  1 cagagagaga aagagagaga gggacttgag ttctgttatc ttcttaagta gattcatatt
 61 gtaagggtct cggggtgggg gggttggcaa aatcctggag ccagaagaaa ggacagcagc
121 attgatcaat cttacagcta acatgttgta cctggaaaac aatgcccaga ctcaatttag
181 tgagccacag tacacgaacc tggggctcct gaacagcatg gaccagcaga ttcagaacgg
241 ctcctcgtcc accagtccct ataacacaga ccacgcgcag aacagcgtca cggcgccctc
301 gccctacgca cagcccagct ccaccttcga tgctctctct ccatcacccg ccatcccctc
361 caacaccgac tacccaggcc cgcacagttt cgacgtgtcc ttccagcagt cgagcaccgc
421 caagtcggcc acctggacgt attccactga actgaagaaa ctctactgcc aaattgcaaa
481 gacatgcccc atccagatca aggtgatgac ccccacctcct cagggagctg ttatccgcgc
541 catgcctgtc tacaaaaaag ctgagcacgt cacggaggtg gtgaagcggt gccccaacca
601 tgagctgagc cgtgaattca acgagggaca gattgcccct cctagtcatt tgattcgagt
661 agaggggaac agccatgccc agtatgtaga agatcccatc acaggaagac agagtgtgct
721 ggtaccttat gagccacccc aggttggcac tgaattcacg acagtcttgt acaatttcat
781 gtgtaacagc agttgtgttg gagggatgaa ccgccgtcca attttaatca ttgttactct
```

TABLE 1-continued

```
 841 ggaaaccaga gatgggcaag tcctgggccg acgctgcttt gaggcccgga tctgtgcttg
 901 cccaggaaga gacaggaagg cggatgaaga tagcatcaga aagcagcaag tttcggacag
 961 tacaaagaac ggtgatgcgt ttcgtcagaa cacacatggt atccagatga catccatcaa
1021 gaaacgaaga tccccagatg atgaactgtt atacttacca gtgaggggcc gtgagactta
1081 tgaaatgctg ttgaagatca aagagtccct ggaactcatg cagtaccttc ctcagcacac
1141 aattgaaacg tacaggcaac agcaacagca gcagcaccag cacttacttc agaaacagac
1201 ctcaatacag tctccatctt catatggtaa cagctcccca cctctgaaca aaatgaacag
1261 catgaacaag ctgccttctg tgagccagct tatcaaccct cagcagcgca acgccctcac
1321 tcctacaacc attcctgatg gcatgggagc caacagatct ggcaagtctg aaaatccctg
1381 agcaatttcg acatgcgatc tggaagggca tcctggacca ccggcagctc cacgaattct
1441 cctccccttc tcatctcctg cggaccccaa gcagtgcctc tacagtcagt gtgggctcca
1501 gtgagacccg gggtgagcgt gttattgatg ctgtgcgatt caccctccgc cagaccatct
1561 ctttcccacc ccgagatgag tggaatgact tcaactttga catggatgct cgccgcaata
1621 agcaacagcg catcaaagag gagggggagt gagcctcacc atgtgagctc ttcctatccc
1681 tctcctaact gccagccccc taaaagcact cctgcttaat cttcaaagcc ttctccctag
1741 ctcctcccct tcctcttgtc tgatttctta ggggaaggag aagtaagagg ctacctctta
1801 cctaacatct gacctggcat ctaattctga ttctggcttt aagccttcaa aactatagct
1861 tgcagaactg tagctgccat ggctaggtag aagtgagcaa aaaagagttg ggtgtctcct
1921 taagctgcag agatttctca ttgactttta taaagcatgt tcacccttat agtctaagac
1981 tatatatata aatgtataaa tatacagtat agatttttgg gtgggggggca ttgagtattg
2041 tttaaaatgt aatttaaatg aaagaaaatt gagttgcact tattgaccat tttttaattt
2101 acttgttttg gatggcttgt ctatactcct tcccttaagg ggtatcatgt atggtgatag
2161 gtatctagag cttaatgcta catgtgagtg acgatgatgt acagattctt tcagttcttt
2221 ggattctaaa tacatgccac atcaaacctt tgagtagatc catttccatt gcttattatg
2281 taggtaagac tgtagatatg tattcttttc tcagtgttgg tatattttat attactgaca
2341 tttcttctag tgatgatggt tcacgttggg gtgatttaat ccagttataa gaagaagttc
2401 atgtccaaac gtcctcttta gtttttggtt gggaatgagg aaaattctta aaaggcccat
2461 agcagccagt tcaaaaacac ccgacgtcat gtatttgagc atatcagtaa ccccccttaaa
2521 tttaatacca gataccttat cttacaatat tgattgggaa aacatttgct gccattacag
2581 aggtattaaa actaaatttc actactagat tgactaactc aaatacacat ttgctactgt
2641 tgtaagaatt ctgattgatt tgattgggat gaatgccatc tatctagttc taacagtgaa
2701 gttttactgt ctattaatat tcagggtaaa taggaatcat tcagaaatgt tgagtctgta
2761 ctaaacagta agatatctca atgaaccata aattcaactt tgtaaaaatc ttttgaagca
2821 tagataatat tgtttggtaa atgtttcttt tgtttggtaa atgtttcttt taaagaccct
2881 cctattctat aaaactctgc atgtagaggc ttgtttacct ttctctctct aaggtttaca
2941 ataggagtgg tgatttgaaa aatataaaat tatgagattg gttttcctgt ggcataaatt
3001 gcatcactgt atcattttct tttttaaccg gtaagagttt cagtttgttg gaaagtaact
3061 gtgagaaccc agtttcccgt ccatctccct tagggactac ccatagacat gaaaggtccc
3121 cacagagcaa gagataagtc tttcatggct gctgttgctt aaaccactta aacgaagagt
3181 tcccttgaaa ctttgggaaa acatgttaat gacaatattc cagatctttc agaaatataa
3241 cacatttttt tgcatgcatg caaatgagct ctgaaatctt cccatgcatt ctggtcaagg
3301 gctgtcattg cacataagct tccattttaa ttttaaagtg caaaagggcc agcgtggctc
3361 taaaaggtaa tgtgtggatt gcctctgaaa agtgtgtata tattttgtgt gaaattgcat
3421 actttgtatt ttgattattt tttttttctt cttgggatag tgggatttcc agaaccacac
3481 ttgaaacctt tttttatcgt ttttgtattt tcatgaaaat accatttagt aagaatacca
3541 catcaaataa gaaataatgc tacaatttta agaggggagg gaagggaaag ttttttttta
3601 ttattttttt aaaattttgt atgttaaaga gaatgagtcc ttgatttcaa agttttgttg
3661 tacttaaatg gtaataagca ctgtaaactt ctgcaacaag catgcagctt tgcaaaccca
3721 ttaaggggaa gaatgaaagc tgttccttgg tcctagtaag aagacaaact gcttccctta
3781 ctttgctgag ggtttgaata aacctaggac ttccgagcta tgtcagtact attcaggtaa
3841 cactagggcc ttggaaattc ctgtactgtg tctcatggat ttggcactag ccaaagcgag
3901 gcacccttac tggcttacct cctcatggca gcctactctc cttgagtgta tgagtagcca
3961 gggtaagggg taaaaggata gtaagcatag aaaccactag aaagtgggct taatggagtt
4021 cttgtggcct cagctcaatg cagttagctg aagaattgaa aagtttttgt ttggagacgt
4081 ttataaacag aaatggaaag cagagttttc attaaatcct tttacctttt ttttttcttg
4141 gtaatcccct aaaataacag tatgtgggat attgaatgtt aaagggatat ttttttctat
4201 tatttttata attgtacaaa attaagcaaa tgttaaaagt tttatatgct ttattaatgt
4261 tttcaaaagg tattatacat gtgatacatt ttttaagctt cagttgcttg tcttctggta
4321 ctttctgtta tgggcttttg gggagccaga agccaatcta caatctcttt ttgtttgcca
4381 ggacatgcaa taaaatttaa aaaataaata aaaactaatt aagaaa
```

SEQ ID NO: 38 Human p63 Isoform 11 Amino Acid Sequence (NP_001316078.1)

```
  1 mlylennaqt qfsepqytnl gllnsmdqqi qngsssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdstkngdaf rqnthgiqmt sikkrrspdd
301 ellylpvrgr etyemllkik eslelmqylp qhtietyrqq qqqhqhllq kqtsiqspss
361 ygnssppln k mnsmnklpsv sqlinpqqrn altpttipdg mganrsgkse np
```

SEQ ID NO: 39 Human p63 transcript variant 12 mRNA Sequence (NM_001329150.2; CDS: 143-1126)

```
  1 cagagagaga aagagagaga gggacttgag ttctgttatc ttcttaagta gattcatatt
 61 gtaagggtct cggggtgggg gggttggcaa aatcctggag ccagaagaaa ggacagcagc
121 attgatcaat cttacagcta acatgttgta cctggaaaac aatgcccaga ctcaatttag
181 tgagtattcc actgaactga agaaactcta ctgccaaatt gcaaagacat gccccatcca
241 gatcaaggtg atgaccccac ctcctcaggg agctgttatc cgcgccatgc ctgtctacaa
301 aaaagctgag cacgtcacgg aggtggtgaa gcggtgcccc aaccatgagc tgagccgtga
361 attcaacgag ggacagattg cccctcctag tcatttgatt cgagtagagg ggaacagcca
421 tgcccagtat gtagaagatc ccatcacagg aagacagagt gtgctggtac cttatgagcc
```

TABLE 1-continued

```
 481 accccaggtt ggcactgaat tcacgacagt cttgtacaat ttcatgtgta acagcagttg
 541 tgttggaggg atgaaccgcc gtccaatttt aatcattgtt actctggaaa ccagagatgg
 601 gcaagtcctg ggccgacgct gctttgaggc ccggatctgt gcttgcccag gaagagacag
 661 gaaggcggat gaagatagca tcagaaagca gcaagtttcg gacagtacaa agaacggtga
 721 tgcgtttcgt cagaacacac atggtatcca gatgacatcc atcaagaaac gaagatcccc
 781 agatgatgaa ctgttatact taccagtgag gggccgtgag acttatgaaa tgctgttgaa
 841 gatcaaagag tccctggaac tcatgcagta ccttcctcag cacacaattg aaacgtacag
 901 gcaacagcaa cagcagcagc accagcactt acttcagaaa cagacctcaa tacagtctcc
 961 atcttcatat ggtaacagct ccccacctct gaacaaaatg aacagcatga acaagctgcc
1021 ttctgtgagc cagcttatca accctcagca gcgcaacgcc ctcactccta caaccattcc
1081 tgatggcatg ggagccaaca gatctggcaa gtctgaaaat ccctgagcaa tttcgacatg
1141 cgatctggaa gggcatcctg gaccaccggc agctccacga attctcctcc ccttctcatc
1201 tcctgcggac cccaagcagt gcctctacag tcagtgtggg ctccagtgag acccggggtg
1261 agcgtgttat tgatgctgtg cgattcaccc tccgccagac catctctttc ccaccccgag
1321 atgagtggaa tgacttcaac tttgacatgg atgctcgccg caataagcaa cagcgcatca
1381 aagaggaggg ggagtgagcc tcaccatgtg agctcttcct atccctctcc taactgccag
1441 ccccctaaaa gcactcctgc ttaatcttca aagccttctc cctagctcct ccccttcctc
1501 ttgtctgatt tcttagggga aggagaagta agaggctacc tcttacctaa catctgacct
1561 ggcatctaat tctgattctg gctttaagcc ttcaaaacta tagcttgcag aactgtagct
1621 gccatggcta ggtagaagtg agcaaaaaag agttgggtgt ctccttaagc tgcagagatt
1681 tctcattgac ttttataaag catgttcacc cttatagtct aagactatat atataaatgt
1741 ataaatatac agtatagatt tttgggtggg gggcattgag tattgtttaa aatgtaattt
1801 aaatgaaaga aaattgagtt gcacttattg accatttttt aatttacttg ttttggatgg
1861 cttgtctata ctccttccct taagggggtat catgtatggt gataggtatc tagagcttaa
1921 tgctacatgt gagtgacgat gatgtacaga ttctttcagt tctttggatt ctaaatacat
1981 gccacatcaa acctttgagt agatccattt ccattgctta ttatgtaggt aagactgtag
2041 atatgtattc ttttctcagt gttggtatat tttatattac tgacatttct tctagtgatg
2101 atggttcacg ttggggtgat ttaatccagt tataagaaga agttcatgtc caaacgtcct
2161 ctttagtttt tggttgggaa tgaggaaaat tcttaaaagg cccatagcag ccagttcaaa
2221 aacacccgac gtcatgtatt tgagcatatc agtaaccccc ttaaatttaa taccagatac
2281 cttatcttac aatattgatt gggaaaacat ttgctgccat tacagaggta ttaaaactaa
2341 atttcactac tagattgact aactcaaata cacatttgct actgttgtaa gaattctgat
2401 tgatttgatt gggatgaatg ccatctatct agttctaaca gtgaagtttt actgtctatt
2461 aatattcagg gtaaatagga atcattcaga aatgttgagt ctgtactaaa cagtaagata
2521 tctcaatgaa ccataaattc aactttgtaa aaatcttttg aagcatagat aatattgttt
2581 ggtaaatgtt tcttttgttt ggtaaatgtt tcttttaaag accctcctat tctataaaac
2641 tctgcatgta gaggcttgtt tacctttctc tctctaaggt ttacaatagg agtggtgatt
2701 tgaaaaatat aaaattatga gattggtttt cctgtggcat aaattgcatc actgtatcat
2761 tttcttttt aaccggtaag agtttcagtt tgttggaaag taactgtgag aacccagttt
2821 cccgtccatc tcccttaggg actacccata gacatgaaag gtccccacag agcaagagat
2881 aagtctttca tggctgctgt tgcttaaacc acttaaacga agagttccct tgaaactttg
2941 ggaaaacatg ttaatgacaa tattccagat ctttcagaaa tataacacat ttttttgcat
3001 gcatgcaaat gagctctgaa atcttcccat gcattctggt caagggctgt cattgcacat
3061 aagcttccat tttaatttta aagtgcaaaa gggccagcgt ggctctaaaa ggtaatgtgt
3121 ggattgcctc tgaaaagtgt gtatatattt tgtgtgaaat tgcatacttt gtattttgat
3181 tattttttt ttcttcttgg gatagtggga tttccagaac cacacttgaa acctttttt
3241 atcgtttttg tattttcatg aaaataccat ttagtaagaa taccacatca aataagaaat
3301 aatgctacaa ttttaagagg ggagggaagg gaaagttttt ttttattatt tttttaaaat
3361 tttgtatgtt aaagagaatg agtccttgat ttcaaagttt tgttgtactt aaatggtaat
3421 aagcactgta aacttctgca acaagcatgc agctttgcaa acccattaag ggaagaatg
3481 aaagctgttc cttggtccta gtaagaagac aaactgcttc ccttactttg ctgagggttt
3541 gaataaacct aggacttccg agctatgtca gtactattca ggtaacacta gggccttgga
3601 aattcctgta ctgtgtctca tggatttggc actagccaaa gcgaggcacc cttactggct
3661 tacctcctca tggcagccta ctctccttga gtgtatgagt agccagggta aggggtaaaa
3721 ggatagtaag catagaaacc actagaaagt gggcttaatg gagttcttgt ggcctcagct
3781 caatgcagtt agctgaagaa ttgaaaagtt tttgtttgga gacgtttata aacagaaatg
3841 gaaagcagag ttttcattaa atcctttac cttttttttt tcttggtaat cccctaaaat
3901 aacagtatgt gggatattga atgttaaagg gatatttttt tctattattt ttataattgt
3961 acaaaattaa gcaaatgtta aaagttttat atgctttatt aatgttttca aaaggtatta
4021 tacatgtgat acattttta agcttcagtt gcttgtcttc tggtactttc tgttatgggc
4081 ttttggggag ccagaagcca atctacaatc tctttttgtt tgccaggaca tgcaataaaa
4141 tttaaaaaat aaataaaaac taattaagaa a
```

SEQ ID NO: 40 Human p63 Isoform 12 Amino Acid Sequence (NP_001316079.1)

```
  1 mlylennaqt qfseystelk klycqiaktc piqikvmtpp pqgaviramp vykkaehvte
 61 vvkrcpnhel srefnegqia ppshlirveg nshaqyvedp itgrqsvlvp yeppqvgtef
121 ttvlynfmcn sscvggmnrr piliivtlet rdgqvlgrrc fearicacpg rdrkadedsi
181 rkqqvsdstk ngdafrqnth giqmtsikkr rspddellyl pvrgretyem llkikeslel
241 mqylpqhtie tyrqqqqqqh qhllqkqtsi qspssygnss pplnkmnsmn klpsvsqlin
301 pqqrnaltpt tipdgmganr sgksenp
```

SEQ ID NO: 41 Human p63 transcript variant 13 mRNA Sequence (NM_001329964.1; CDS: 438-2474)

```
  1 ggcaacccgc tggggtcacc ttccacactg tggaagcttt gttcttttgc tctttgcagt
 61 aaatcttgct actgctcact ctttgggtgc acactgcttt tatgagctgt aacactcacc
121 gtgaaggtct gcagcttcac tcctgaagcc agcgagacca ggagtccact gggaggaacg
181 aacaactcca gacgcaccgc cttaagaact tcaacactca ctgcgaaggt ctgcagcttc
241 actcctgagc cagcgagacc acgaacccac cgtaaggaag aaactccgaa cacatccgaa
301 catcagaagg aacaaactcc agacgcgcca ccttaagagc tgtaacactc accgccaggg
361 tccgcggctt cattcttgaa gtcagagaga ccaagaaccc accaattccg gacaccctat
```

TABLE 1-continued

| | | | | | | |
|---|---|---|---|---|---|---|
| 421 | cagagatttt | gaaaactatg | aagtgctggg | aacagagaga | ctggacagcc | ttcacaaagg |
| 481 | tggggaaacc | ttgtttcgta | gaaaccccag | ctcatttctc | ttggaaagaa | agttattacc |
| 541 | gatccaccat | gtcccagagc | acacagacaa | atgaattcct | cagtccagag | gttttccagc |
| 601 | atatctggga | ttttctggaa | cagcctatat | gttcagttca | gcccattgac | ttgaactttg |
| 661 | tggatgaacc | atcagaagat | ggtgcgacaa | acaagattga | gattagcatg | gactgtatcc |
| 721 | gcatgcagga | ctcggacctg | agtgacccca | tgtggccaca | gtacacgaac | ctggggctcc |
| 781 | tgaacagcat | ggaccagcag | attcagaacg | gctcctcgtc | caccagtccc | tataacacag |
| 841 | accacgcgca | gaacagcgtc | acggcgccct | cgccctacgc | acagcccagc | tccaccttcg |
| 901 | atgctctctc | tccatcaccc | gccatcccct | ccaacaccga | ctacccaggc | ccgcacagtt |
| 961 | tcgacgtgtc | cttccagcag | tcgagcaccg | ccaagtcggc | cacctggacg | tattccactg |
| 1021 | aactgaagaa | actctactgc | caaattgcaa | agacatgccc | catccagatc | aaggtgatga |
| 1081 | ccccacctcc | tcagggagct | gttatccgcg | ccatgcctgt | ctacaaaaaa | gctgagcacg |
| 1141 | tcacggaggt | ggtgaagcgg | tgccccaacc | atgagctgag | ccgtgaattc | aacgagggac |
| 1201 | agattgcccc | tcctagtcat | ttgattcgag | tagaggggaa | cagccatgcc | cagtatgtag |
| 1261 | aagatcccat | cacaggaaga | cagagtgtgc | tggtacctta | tgagccaccc | caggttggca |
| 1321 | ctgaattcac | gacagtcttg | tacaatttca | tgtgtaacag | cagttgtgtt | ggagggatga |
| 1381 | accgccgtcc | aattttaatc | attgttactc | tggaaaccag | agatgggcaa | gtcctgggcc |
| 1441 | gacgctgctt | tgaggcccgg | atctgtgctt | gcccaggaag | agacaggaag | gcggatgaag |
| 1501 | atagcatcag | aaagcagcaa | gtttcggaca | gtacaaagaa | cggtgatggt | acgaagcgcc |
| 1561 | cgtttcgtca | gaacacacat | ggtatccaga | tgacatccat | caagaaacga | agatccccag |
| 1621 | atgatgaact | gttatactta | ccagtgaggg | gccgtgagac | ttatgaaatg | ctgttgaaga |
| 1681 | tcaaagagtc | cctggaactc | atgcagtacc | ttcctcagca | cacaattgaa | acgtacaggc |
| 1741 | aacagcaaca | gcagcagcac | cagcacttac | ttcagaaaca | gacctcaata | cagtctccat |
| 1801 | cttcatatgg | taacagctcc | ccacctctga | acaaaatgaa | cagcatgaac | aagctgcctt |
| 1861 | ctgtgagcca | gcttatcaac | cctcagcagc | gcaacgccct | cactcctaca | accattcctg |
| 1921 | atggcatggg | agccaacatt | cccatgatgg | gcacccacat | gccaatggct | ggagacatga |
| 1981 | atggactcag | ccccacccag | gcactccctc | ccccactctc | catgccatcc | acctcccact |
| 2041 | gcacaccccc | acctccgtat | cccacagatt | gcagcattgt | cagtttctta | gcgaggttgg |
| 2101 | gctgttcatc | atgtctggac | tatttcacga | cccaggggct | gaccaccatc | tatcagattg |
| 2161 | agcattactc | catggatgat | ctggcaagtc | tgaaaatccc | tgagcaattt | cgacatgcga |
| 2221 | tctggaaggg | catcctggac | caccggcagc | tccacgaatt | ctcctcccct | tctcatctcc |
| 2281 | tgcggacccc | aagcagtgcc | tctacagtca | gtgtgggctc | cagtgagacc | cggggtgagc |
| 2341 | gtgttattga | tgctgtgcga | ttcaccctcc | gccagaccat | ctctttccca | ccccgagatg |
| 2401 | agtggaatga | cttcaacttt | gacatggatg | ctcgccgcaa | taagcaacag | cgcatcaaag |
| 2461 | aggaggggga | gtgagcctca | ccatgtgagc | tcttcctatc | cctctcctaa | ctgccagccc |
| 2521 | cctaaaagca | ctcctgctta | atcttcaaag | ccttctccct | agctcctccc | cttcctcttg |
| 2581 | tctgatttct | taggggaagg | agaagtaaga | ggctacctct | tacctaacat | ctgacctggc |
| 2641 | atctaattct | gattctggct | ttaagccttc | aaaactatag | cttgcagaac | tgtagctgcc |
| 2701 | atggctaggt | agaagtgagc | aaaaaagagt | tgggtgtctc | cttaagctgc | agagatttct |
| 2761 | cattgacttt | tataaagcat | gttcaccctt | atagtctaag | actatatata | taaatgtata |
| 2821 | aatatacagt | atagattttt | gggtgggggg | cattgagtat | tgtttaaaat | gtaatttaaa |
| 2881 | tgaaagaaaa | ttgagttgca | cttattgacc | atttttttaat | ttacttgttt | tggatggctt |
| 2941 | gtctatactc | cttcccttaa | ggggtatcat | gtatggtgat | aggtatctag | agcttaatgc |
| 3001 | tacatgtgag | tgacgatgat | gtacagattc | tttcagttct | ttggattcta | aatacatgcc |
| 3061 | acatcaaacc | tttgagtaga | tccatttcca | ttgcttatta | tgtaggtaag | actgtagata |
| 3121 | tgtattcttt | tctcagtgtt | ggtatatttt | atattactga | catttcttct | agtgatgatg |
| 3181 | gttcacgttg | gggtgattta | atccagttat | aagaagaagt | tcatgtccaa | acgtcctctt |
| 3241 | tagtttttgg | ttgggaatga | ggaaaattct | taaaaggccc | atagcagcca | gttcaaaaac |
| 3301 | acccgacgtc | atgtatttga | gcatatcagt | aacccccctta | aatttaatac | cagatacctt |
| 3361 | atcttacaat | attgattggg | aaaacatttg | ctgccattac | agaggtatta | aaactaaatt |
| 3421 | tcactactag | attgactaac | tcaaatacac | atttgctact | gttgtaagaa | ttctgattga |
| 3481 | tttgattggg | atgaatgcca | tctatctagt | tctaacagtg | aagttttact | gtctattaat |
| 3541 | attcagggta | aataggaatc | attcagaaat | gttgagtctg | tactaaacag | taagatatct |
| 3601 | caatgaacca | taaattcaac | tttgtaaaaa | tcttttgaag | catagataat | attgtttggt |
| 3661 | aaatgtttct | tttgtttggt | aaatgtttct | tttaaagacc | ctcctattct | ataaaactct |
| 3721 | gcatgtagag | gcttgtttac | ctttctctct | ctaaggttta | caataggagt | ggtgatttga |
| 3781 | aaaatataaa | attatgagat | tggttttcct | gtggcataaa | ttgcatcact | gtatcatttt |
| 3841 | ctttttaac | cggtaagagt | ttcagtttgt | tggaaagtaa | ctgtgagaac | ccagtttccc |
| 3901 | gtccatctcc | cttagggact | acccatagac | atgaaaggtc | cccacagagc | aagagataag |
| 3961 | tctttcatgg | ctgctgttgc | ttaaaccact | taaacgaaga | gttcccttga | aactttggga |
| 4021 | aaacatgtta | atgacaatat | tccagatctt | tcagaaatat | aacacatttt | tttgcatgca |
| 4081 | tgcaaatgag | ctctgaaatc | ttcccatgca | ttctggtcaa | gggctgtcat | tgcacataag |
| 4141 | cttccatttt | aattttaaag | tgcaaaaggg | ccagcgtggc | tctaaaaggt | aatgtgtgga |
| 4201 | ttgcctctga | aaagtgtgta | tatatttgt | gtgaaattgc | atactttgta | ttttgattat |
| 4261 | ttttttttc | ttcttgggat | agtgggattt | ccagaaccac | acttgaaacc | tttttttatc |
| 4321 | gtttttgtat | tttcatgaaa | ataccattta | gtaagaatac | cacatcaaat | aagaaataat |
| 4381 | gctacaattt | taagagggga | gggaagggaa | agttttttt | tattattttt | ttaaaatttt |
| 4441 | gtatgttaaa | gagaatgagt | ccttgatttc | aaagttttgt | tgtacttaaa | tggtaataag |
| 4501 | cactgtaaac | ttctgcaaca | agcatgcagc | tttgcaaacc | cattaagggg | aagaatgaaa |
| 4561 | gctgttcctt | ggtcctagta | agaagacaaa | ctgcttccct | tactttgctg | agggtttgaa |
| 4621 | taaacctagg | acttccgagc | tatgtcagta | ctattcaggt | aacactaggg | ccttggaaat |
| 4681 | tcctgtactg | tgtctcatgg | atttggcact | agccaaagcg | aggcaccctt | actggcttac |
| 4741 | ctcctcatgg | cagcctactc | tccttgagtg | tatgagtagc | cagggtaagg | ggtaaaagga |
| 4801 | tagtaagcat | agaaaccact | agaaagtggg | cttaatggag | ttcttgtggc | ctcagctcaa |
| 4861 | tgcagttagc | tgaagaattg | aaaagttttt | gtttggagac | gtttataaac | agaaatggaa |
| 4921 | agcagagttt | tcattaaatc | ctttacctt | ttttttttct | tggtaatccc | ctaaaataac |
| 4981 | agtatgtggg | atattgaatg | ttaaagggat | attttttct | attattttta | taattgtaca |

TABLE 1-continued 5041 aaattaagca aatgttaaaa gttttatatg ctttattaat gttttcaaaa ggtattatac
5101 atgtgataca ttttttaagc ttcagttgct tgtcttctgg tactttctgt tatgggcttt
5161 tggggagcca gaagccaatc tacaatctct ttttgtttgc caggacatgc aataaaattt
5221 aaaaaataaa taaaaactaa ttaagaaatt gaaaaaaaaa aaaaaaaaa SEQ ID NO: 42 Human p63 Isoform 13 Amino Acid Sequence (NP_001316893.1)
1 mkcweqrdwt aftkvgkpcf vetpahfswk esyyrstmsq stqtneflsp evfqhiwdfl
61 eqpicsvqpi dlnfvdepse dgatnkieis mdcirmqdsd lsdpmwpqyt nlgllnsmdq
121 qiqngsssts pyntdhaqns vtapspyaqp sstfdalsps paipsntdyp gphsfdvsfq
181 qsstaksatw tystelkkly cqiaktcpiq ikvmtpppqg avirampvyk kaehvtevvk
241 rcpnhelsre fnegqiapps hlirvegnsh aqyvedpitg rqsvlvpyep pqvgtefttv
301 lynfmcnssc vggmnrrpil iivtletrdg qvlgrrcfea ricacpgrdr kadedsirkq
361 qvsdstkngd gtkrpfrqnt hgiqmtsikk rrspddelly lpvrgretye mllkikesle
421 lmqylpqhti etyrqqqqqq hqhllqkqts iqspssygns spplnkmnsm nklpsvsqli
481 npqqrnaltp ttipdgmgan ipmmgthmpm agdmnglspt qalppplsmp stshctpppp
541 yptdcsivsf larlgcsscl dyfttqgltt iyqiehysmd dlaslkipeq frhaiwkgil
601 dhrqlhefss pshllrtpss astvsvgsse trgervidav rftlrqtisf pprdewndfn
661 fdmdarrnkq qrikeege SEQ ID NO: 43 Mouse p63 transcript variant 1 mRNA Sequence (NM_001127259.1; CDS: 526-2568)
1 aaaacattgt agccacagca gaactgacag gagctctcaa atcaagtcag aatacagata
61 caaggagatg ttattcagtt ggagcaaggg ggacatttat tagctcagtg acaagtcctg
121 gcttctgtga ttaaactctg atgccattca taccagcacc caatcccaag caagatcaga
181 agttcagaga tgcctacaaa ttgccaacaa gtgtggccac tctacgtcaa gggctctaaa
241 actgtggcag agaggaagaa cagctttaca gggggtgccc agctggtaag aattgacggt
301 ttatgatgct ctggttactt gaagactctc attggctgaa aggaagaaac gccccgcctc
361 tttgcaaatc tgagtaaagg ggggaagtgt ctaaacttct atgtctgatg gcatttgacc
421 ctattgcttt cagcctcctg gctacatacc tagatattct caggtgtata tgtatatttt
481 atagaattgc ttcccatctg ttggtatcaa agagagttga aggaaatgaa ttttgaaact
541 tcacggtgtg ccaccctaca gtactgcccc gacccttaca tccagcgttt catagaaacc
601 ccagctcatt tctcgtggaa agaaagttat tacagatctg ccatgtcgca gagcacccag
661 acaagcgagt tcctcagccc agaggtcttc cagcatatct gggatttttct ggaacagcct
721 atatgctcag tacagcccat cgagttgaac tttgtggatg aaccttccga aaatggtgca
781 acaaacaaga ttgagattag catggattgt atccgcatgc aagactcaga cctcagtgac
841 cccatgtggc cacagtacac gaacctgggg ctcctgaaca gcatggacca gcagattcag
901 aacggctcct cgtccaccag ccccctacaac acagaccacg cacagaatag cgtgacggcg
961 ccctcgccct atgcacagcc cagctccacc tttgatgccc tctctccatc ccctgccatt
1021 ccctccaaca cagattaccc gggcccacac agcttcgatg tgtccttcca gcagtcaagc
1081 actgccaagt cagccacctg gacgtattcc accgaactga agaagctgta ctgccagatt
1141 gcgaagacat gccccatcca gatcaaggtg atgaccccac ccccacaggg cgctgttatc
1201 cgtgccatgc ctgtctacaa gaaagctgag catgtcaccg aggttgtgaa acgatgccct
1261 aaccatgagc tgagccgtga gttcaatgag ggacagattg cccctcccag tcatctgatt
1321 cgagtagaag ggaacagcca tgcccagtat gtagaagatc ctatcacggg aaggcagagc
1381 gtgctggtcc cttatgagcc accacaggtt ggcactgaat tcacaacagt cctgtacaat
1441 ttcatgtgta acagcagctg cgtcggagga atgaacagac gtccaatttt aatcatcgtt
1501 actctggaaa ccagagatgg gcaagtcctg ggccgacggt gctttgaggc ccggatctgt
1561 gcttgcccag gaagagaccg gaaggcagat gaagacagca tcagaaagca gcaagtatcg
1621 gacagcgcaa agaacggcga tggtacgaag cgcccctttcc gtcagaatac acacggaatc
1681 cagatgactt ccatcaagaa acggagatcc ccagatgatg agctgctgta cctaccagtg
1741 agaggtcgtg agacgtacga gatgttgctg aagatcaaag agtcactgga gctcatgcag
1801 tacctccctc agcacacgat cgaaacgtac aggcagcagc agcagcagca gcaccagcac
1861 ctacttcaga aacagacctc gatgcagtct cagtcttcat atggcaacag ttccccacct
1921 ctgaacaaaa tgaacagcat gaacaagctg ccttccgtga gccagcttat caacccacag
1981 cagcgcaatg ccctcactcc caccaccatg cctgagggca tgggagccaa cattcctatg
2041 atgggcactc acatgccaat ggctggagac atgaatggac tcagccctac ccaagctctc
2101 cctcctccac tctccatgcc ctccacctcc cactgcaccc caccaccgcc ctaccccaca
2161 gactgcagca ttgtcagttt cttagcaagg ttgggctgct catcatgcct ggactatttc
2221 acgacccagg ggctgaccac catctatcag attgagcatt actccatgga tgatttggca
2281 agtctgaaga tccctgaaca gttccgacat gccatctgga agggcatcct ggaccacagg
2341 cagctgcacg acttctcctc acctcctcat ctcctgagga ccccaagtgg tgcctctacc
2401 gtcagtgtgg gctccagtga gacccgtggt gaacgtgtga tcgatgccgt gcgctttacc
2461 ctccgccaga ccatctcttt tccaccccgt gacgagtgga atgatttcaa ctttgacatg
2521 gattctcgtc gcaacaagca gcagcgtatc aaagaggaag gagaatgagc gcccattgcg
2581 gggttcttcc tgtcttcttc cacctcccag cccctacagg gcacgcctgc ttgatcctca
2641 gagccttctc gttagctctt ctccttctcc ttctcagtct ggtttctaaa gggacggaga
2701 attaggaggc tgcctgttac ctaaagtctg acctgtcacc tgattctgat tctggcttta
2761 agccttcaat actcttgctt gcaagatgca ttgacattgc tagatagaag ttagcaaaga
2821 agcagtaggt ctctttaagc agtggagatc tctcattgac ttttataaag cattttcagc
2881 cttatagtct aagactatat atataaatat ataaatatcc gatatatatt ttgggtgtgg
2941 ggggtattga gtattgttta aatgtaattt aatggaaatt gagttgcact tatcatcctt
3001 ctttggaatt tgcttgtttc ggatggctga gctgtactcc tttctcaggg gtatcatgta
3061 tggtgacaga tatctagagt tgaatggtct atgtgagtaa caatgacgta taggacctct
3121 cctcatcctt tggatggtta ttgtttagca catcaaacct gtggatgcat ccagtgtgtt
3181 taccattgct tcctatgagg taaaactgta tatatgtaca cagttttctc tgtcagtata
3241 ttttatgtta ctggtgtcca ttccagttag gctggttcac tctgtggcta ttacaagcca
3301 cattttaggt ttgctttgtc acacactata agacagggca ttgtctcttg cttttgtttg
3361 agaatgagga atgcagttgt gttgtggttt gttttgtttt attttgtttt gttttctgga
3421 aactcttaaa tggttcaagt cagccattcc aaatatctga tgaaatttag cccaatatag
3481 cagtagctct ttgaaattta aggcccaaca ccctagtatt tattagaaaa ataaacattt TABLE 1-continued

```
3541 gctgttgtta gaatagtctt aaaaataaat ttctctgcta gattgactaa gtaaaataga
3601 cattctctgc tgttgtgaga atttgggcca attagaatga atgaaattcg tctagttttc
3661 atggggagtt gtaatgtcta ttagaaagat tcaggaaaaa taagaatgat tcagaaatac
3721 tgaatttcca tgaaaaggaa aacagaaagc gattcatccc accaaactct gaattgaagt
3781 tccttttgaa gggtggagtg atgcttggga agtggacctt ttaaagactt tcctatctat
3841 gagacactgc atgcacaggc aagtttctct ctccccaagg gctaaaataa gaataatggc
3901 ttggaaaata caaacttcgt agtgtagttt tcacatagca tgagctgaac cactgttatc
3961 ttcctcttga tcatcaaagc ttcattgttt tagaaagcag aggtgaagac ccagttttcc
4021 gcctgacact ttccaagcta gtgtagacca agacctgtct acaaacccac gacaaacctt
4081 ttcacctgtt taatccatat ccagaaagac ttgtttcata ccttgggaaa gcatgcaaca
4141 gtattcccct tagatatttt ggaaacattt tgagacaagt atattttttt tcctgcctaa
4201 accaagtgtt gtttgtatgc taatgagctc tacaatcttc ccacacattt tgttaaatga
4261 ctttcattgc acatgagctc ccatttttta ttttaaagtg caaatgggct aataggcctt
4321 tgacgtgtaa tgtatgagtt ttgccagaaa atcatatctt gtgtatatgc gtgtgtgtga
4381 aattgcttac tatgctggtt ttgtttgtta tggctttctc tttgggatag ttgggtttttc
4441 cagaaccaca gatgaaactt tttttgttgc tatttttata tttttgcaga aacaccgttt
4501 agtgagaatt caatgtcaaa tatgacatga taccttaatt gtaagaagaa ggtgggaagg
4561 gaaagttggt ttattaattt ttttaaattt tgtatgcaaa agcaaatgag tccttaattt
4621 caacattttg ttgtgtttaa ataatgataa gcatcattaa cttctgtaac aaactcacag
4681 ctttacaaat tcaatgggtg gagaagaaag ctgtgtctta gccatgttag gaagacaaat
4741 ggcttcctgt gtgttgtaag tatttgggct gtttcagcag tgttggtgtg gcacagggga
4801 ctctgtggca tttcagcact atttaggtgg cactagggac tctgaaattc ctgtactgta
4861 tctgatgatt ttggcattag ccataggtag gcacagtttg tctcctcaca ccagtgttta
4921 gtgtgtgaat agccagagct gtggggaaga acacagagaa cagacatctg ctggatgcct
4981 ctcagtggag aatgggattc cttcacttgg tggtgaagca gataggatag aaagcaggat
5041 tctctttgtt aatccagtta gcttttgttt tcttgatatc ccccctgaat acgttgagta
5101 tgagagatat gtgggttttt tttattttta taattgtaca aaattaagca aatatcaaat
5161 gttttatata ctttattaat gttttttttc aaaaggtact ttcttataga catgatactt
5221 ttttacagct tcagttgctt gtcttctggt atttttgtgt tatgggctat ggtgagccag
5281 aggcaaatct ataagccatt tttgtttgcc aggacatgca ataaaattta aaaataaatg
5341 aaaatacact gaaaaaaaaa aaaaaaaaaa aaaaaaaaaa aa
```

SEQ ID NO: 44 Mouse p63 Isoform A Amino Acid Sequence (NP_001120731.1)

```
  1 mnfetsrcat lqycpdpyiq rfietpahfs wkesyyrsam sqstqtsefl spevfqhiwd
 61 fleqpicsvq pielnfvdep sengatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdsakn gdgtkrpfrq nthgiqmtsi kkrrspddel lylpvrgret yemllkikes
421 lelmqylpqh tietyrqqqq qqhqhllqkq tsmqsqssyg nssppInkmn smnklpsvsq
481 linpqqrnal tpttmpegmg anipmmgthm pmagdmngls ptqalpppls mpstshctpp
541 ppyptdcsiv sflarlgcss cldyfttqgl ttiyqiehys mddlaslkip eqfrhaiwkg
601 ildhrqlhdf sspphllrtp sgastvsvgs setrgervid avrftlrqti sfpprdewnd
661 fnfdmdsrrn kqqrikeege
```

SEQ ID NO: 45 Mouse p63 transcript variant 2 mRNA Sequence (NM_001127260.1; CDS: 526-2193)

```
   1 aaaacattgt agccacagca gaactgacag gagctctcaa atcaagtcag aatacagata
  61 caaggagatg ttattcagtt ggagcaaggg ggacatttat tagctcagtg acaagtcctg
 121 gcttctgtga ttaaactctg atgccattca taccagcacc caatcccaag caagatcaga
 181 agttcagaga tgcctacaaa ttgccaacaa gtgtggccac tctacgtcaa gggctctaaa
 241 actgtggcag agaggaagaa cagctttaca gggggtgccc agctggtaag aattgacggt
 301 ttatgatgct ctggttactt gaagactctc attggctgaa aggaagaaac gccccgcctc
 361 tttgcaaatc tgagtaaagg ggggaagtgt ctaaacttct atgtctgatg gcatttgacc
 421 ctattgcttt cagcctcctg gctacatacc tagatattct caggtgtata tgtatatttt
 481 atagaattgc ttcccatctg ttggtatcaa agagagttga aggaaatgaa ttttgaaact
 541 tcacggtgtg ccaccctaca gtactgcccc gacccttaca tccagcgttt catagaaacc
 601 ccagctcatt tctcgtggaa agaaagttat tacagatctg ccatgtcgca gagcacccag
 661 acaagcgagt tcctcagccc agaggtcttc cagcatatct gggattttct ggaacagcct
 721 atatgctcag tacagcccat cgagttgaac tttgtggatg aaccttccga aaatggtgca
 781 acaaacaaga ttgagattag catggattgt atccgcatgc aagactcaga cctcagtgac
 841 cccatgtggc cacagtacac gaacctgggg ctcctgaaca gcatggacca gcagattcag
 901 aacggctcct cgtccaccag cccctacaac acagaccacg cacagaatag cgtgacggcg
 961 ccctcgccct atgcacagcc cagctccacc tttgatgccc tctctccatc ccctgccatt
1021 ccctccaaca cagattaccc gggcccacac agcttcgatg tgtccttcca gcagtcaagc
1081 actgccaagt cagccacctg gacgtattcc accgaactga agaagctgta ctgccagatt
1141 gcgaagacat gccccatcca gatcaaggtg atgaccccac ccccacaggg cgctgttatc
1201 cgtgccatgc ctgtctacaa gaaagctgag catgtcaccg aggttgtgaa acgatgccct
1261 aaccatgagc tgagccgtga gttcaatgag ggacagattg cccctcccag tcatctgatt
1321 cgagtagaag ggaacagcca tgcccagtat gtagaagatc ctatcacggg aaggcagagc
1381 gtgctggtcc cttatgagcc accacaggtt ggcactgaat tcacaacagt cctgtacaat
1441 ttcatgtgta acagcagctg cgtcggagga atgaacagac gtccaatttt aatcatcgtt
1501 actctggaaa ccagagatgg gcaagtcctg ggccgacggt gctttgaggc ccggatctgt
1561 gcttgcccag gaagagaccg gaaggcagat gaagacagca tcagaaagca gcaagtatcg
1621 gacagcgcaa agaacggcga tggtacgaag cgcccctttcc gtcagaatac acacggaatc
1681 cagatgactt ccatcaagaa acggagatcc ccagatgatg agctgctgta cctaccagtg
1741 agaggtcgtg agacgtacga gatgttgctg aagatcaaag agtcactgga gctcatgcag
1801 tacctccctc agcacacgat cgaaacgtac aggcagcagc agcagcagca gcaccagcac
1861 ctacttcaga aacagacctc gatgcagtct cagtcttcat atggcaacag ttccccacct
```

TABLE 1-continued 1921 ctgaacaaaa tgaacagcat gaacaagctg ccttccgtga gccagcttat caacccacag
1981 cagcgcaatg ccctcactcc caccaccatg cctgagggca tgggagccaa cattcctatg
2041 atgggcactc acatgccaat ggctggagac atgaatggac tcagccctac ccaagctctc
2101 cctcctccac tctccatgcc ctccacctcc cactgcaccc caccaccgcc ctaccccaca
2161 gactgcagca ttgtcaggat ttggcaagtc tgaagatccc tgaacagttc cgacatgcca
2221 tctggaaggg catcctggac cacaggcagc tgcacgactt ctcctcacct cctcatctcc
2281 tgaggacccc aagtggtgcc tctaccgtca gtgtgggctc cagtgagacc cgtggtgaac
2341 gtgtgatcga tgccgtgcgc tttaccctcc gccagaccat ctcttttcca ccccgtgacg
2401 agtggaatga tttcaacttt gacatggatt ctcgtcgcaa caagcagcag cgtatcaaag
2461 aggaaggaga atgagcgccc attgcggggt tcttcctgtc ttcttccacc tcccagcccc
2521 tacagggcac gcctgcttga tcctcagagc cttctcgtta gctcttctcc ttctccttct
2581 cagtctggtt tctaaaggga cggagaatta ggaggctgcc tgttacctaa agtctgacct
2641 gtcacctgat tctgattctg gctttaagcc ttcaatactc ttgcttgcaa gatgcattga
2701 cattgctaga tagaagttag caaagaagca gtaggtctct ttaagcagtg gagatctctc
2761 attgactttt ataaagcatt ttcagcctta tagtctaaga ctatatatat aaatatataa
2821 atatccgata tatattttgg gtgtgggggg tattgagtat tgtttaaatg taatttaatg
2881 gaaattgagt tgcacttatc atccttcttt ggaatttgct tgtttcggat ggctgagctg
2941 tactcctttc tcaggggtat catgtatggt gacagatatc tagagttgaa tggtctatgt
3001 gagtaacaat gacgtatagg acctctcctc atcctttgga tggttattgt ttagcacatc
3061 aaacctgtgg atgcatccag tgtgtttacc attgcttcct atgaggtaaa actgtatata
3121 tgtacacagt tttctctgtc agtatatttt atgttactgg tgtccattcc agttaggctg
3181 gttcactctg tggctattac aagccacatt ttaggtttgc tttgtcacac actataagac
3241 agggcattgt ctcttgcttt tgtttgagaa tgaggaatgc agttgtgttg tggtttgttt
3301 tgttttattt tgttttgttt tctggaaact cttaaatggt tcaagtcagc cattccaaat
3361 atctgatgaa atttagccca atatagcagt agctctttga aatttaaggc ccaacaccct
3421 agtatttatt agaaaaataa acatttgctg ttgttagaat agtcttaaaa ataaatttct
3481 ctgctagatt gactaagtaa aatagacatt ctctgctgtt gtgagaattt gggccaatta
3541 gaatgaatga aattcgtcta gttttcatgg ggagttgtaa tgtctattag aaagattcag
3601 gaaaaataag aatgattcag aaatactgaa tttccatgaa aaggaaaaca gaaagcgatt
3661 catcccacca aactctgaat tgaagttcct tttgaagggt ggagtgatgc ttgggaagtg
3721 gacctttaa agactttcct atctatgaga cactgcatgc acaggcaagt ttctctctcc
3781 ccaagggcta aaataagaat aatggcttgg aaaatacaaa cttcgtagtg tagttttcac
3841 atagcatgag ctgaaccact gttatcttcc tcttgatcat caaagcttca ttgttttaga
3901 aagcagaggt gaagacccag ttttccgcct gacactttcc aagctagtgt agaccaagac
3961 ctgtctacaa acccacgaca aacctttca cctgtttaat ccatatccag aaagacttgt
4021 ttcatacctt gggaaagcat gcaacagtat tcccttaga tattttggaa acattttgag
4081 acaagtatat tttttttcct gcctaaacca agtgttgttt gtatgctaat gagctctaca
4141 atcttcccac acattttgtt aaatgacttt cattgcacat gagctcccat tttttatttt
4201 aaagtgcaaa tgggctaata ggcctttgac gtgtaatgta tgagttttgc cagaaaatca
4261 tatcttgtgt atatgcgtgt gtgtgaaatt gcttactatg ctggttttgt ttgttatggc
4321 tttctctttg ggatagttgg gttttccaga accacagatg aaactttttt tgttgctatt
4381 tttatatttt tgcagaaaca ccgtttagtg agaattcaat gtcaaatatg acatgatacc
4441 ttaattgtaa gaagaaggtg ggaagggaaa gttggtttat taattttttt aaattttgta
4501 tgcaaaagca aatgagtcct taatttcaac attttgttgt gtttaaataa tgataagcat
4561 cattaacttc tgtaacaaac tcacagcttt acaaattcaa tgggtggaga agaaagctgt
4621 gtcttagcca tgttaggaag acaaatggct tcctgtgtgt tgtaagtatt tgggctgttt
4681 cagcagtgtt ggtgtggcac aggggactct gtggcatttc agcactattt aggtggcact
4741 agggactctg aaattcctgt actgtatctg atgattttgg cattagccat aggtaggcac
4801 agtttgtctc ctcacaccag tgtttagtgt gtgaatagcc agagctgtgg ggaagaacac
4861 agagaacaga catctgctgg atgcctctca gtggagaatg ggattccttc acttggtggt
4921 gaagcagata ggatagaaag caggattctc tttgttaatc cagttagctt ttgttttctt
4981 gatatccccc ctgaatacgt tgagtatgag agatatgtgg gttttttta tttttataat
5041 tgtacaaaat taagcaaata tcaaatgttt tatatacttt attaatgttt tttttcaaaa
5101 ggtactttct tatagacatg atactttttt acagcttcag ttgcttgtct tctggtattt
5161 ttgtgttatg ggctatggtg agccagaggc aaatctataa gccattttg tttgccagga
5221 catgcaataa aatttaaaaa taaatgaaaa tacactgaaa aaaaaaaaaa aaaaaaaaaa
5281 aaaaaaaa SEQ ID NO: 46 Mouse p63 Isoform B Amino Acid Sequence (NP_001120732.1)
1 mnfetsrcat lqycpdpyiq rfietpahfs wkesyyrsam sqstqtsefl spevfqhiwd
61 fleqpicsvq pielnfvdep sengatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdsakn gdgtkrpfrq nthgiqmtsi kkrrspddel lylpvrgret yemllkikes
421 lelmqylpqh tietyrqqqq qqhqhllqkq tsmqsqssyg nssplnkmn smnklpsvsq
481 linpqqrnal tpttmpegmg anipmmgthm pmagdmngls ptqalpppls mpstshctpp
541 ppyptdcsiv riwqv SEQ ID NO: 47 Mouse p63 transcript variant 3 mRNA Sequence (NM_001127261.1;
CDS: 526-1977)
1 aaaacattgt agccacagca gaactgacag gagctctcaa atcaagtcag aatacagata
61 caaggagatg ttattcagtt ggagcaaggg ggacatttat tagctcagtg acaagtcctg
121 gcttctgtga ttaaactctg atgccattca taccagcacc caatcccaag caagatcaga
181 agttcagaga tgcctacaaa ttgccaacaa gtgtggccac tctacgtcaa gggctctaaa
241 actgtggcag agaggaagaa cagctttaca gggggtgccc agctggtaag aattgacggt
301 ttatgatgct ctggttactt gaagactctc attggctgaa aggaagaaac gccccgcctc
361 tttgcaaatc tgagtaaagg ggggaagtgt ctaaacttct atgtctgatg gcatttgacc
421 421 ctattgcttt cagcctcctg gctacatacc tagatattct caggtgtata tgtatatttt TABLE 1-continued

```
 481 atagaattgc ttcccatctg ttggtatcaa agagagttga aggaaatgaa ttttgaaact
 541 tcacggtgtg ccaccctaca gtactgcccc gacccttaca tccagcgttt catagaaacc
 601 ccagctcatt tctcgtggaa agaaagttat tacagatctg ccatgtcgca gagcacccag
 661 acaagcgagt tcctcagccc agaggtcttc cagcatatct gggattttct ggaacagcct
 721 atatgctcag tacagcccat cgagttgaac tttgtggatg aaccttccga aaatggtgca
 781 acaaacaaga ttgagattag catggattgt atccgcatgc aagactcaga cctcagtgac
 841 cccatgtggc cacagtacac gaacctgggg ctcctgaaca gcatggacca gcagattcag
 901 aacggctcct cgtccaccag cccctacaac acagaccacg cacagaatag cgtgacggcg
 961 ccctcgccct atgcacagcc cagctccacc tttgatgccc tctctccatc ccctgccatt
1021 ccctccaaca cagattaccc gggcccacac agcttcgatg tgtccttcca gcagtcaagc
1081 actgccaagt cagccacctg gacgtattcc accgaactga agaagctgta ctgccagatt
1141 gcgaagacat gccccatcca gatcaaggtg atgaccccac ccccacaggg cgctgttatc
1201 cgtgccatgc ctgtctacaa gaaagctgag catgtcaccg aggttgtgaa acgatgccct
1261 aaccatgagc tgagccgtga gttcaatgag ggacagattg cccctcccag tcatctgatt
1321 cgagtagaag ggaacagcca tgcccagtat gtagaagatc ctatcacggg aaggcagagc
1381 gtgctggtcc cttatgagcc accacaggtt ggcactgaat tcacaacagt cctgtacaat
1441 ttcatgtgta acagcagctg cgtcggagga atgaacagac gtccaatttt aatcatcgtt
1501 actctggaaa ccagagatgg gcaagtcctg ggccgacggt gctttgaggc ccggatctgt
1561 gcttgcccag gaagagaccg gaaggcagat gaagacagca tcagaaagca gcaagtatcg
1621 gacagcgcaa agaacggcga tgctttccgt cagaatacac acggaatcca gatgacttcc
1681 atcaagaaac ggagatcccc agatgatgag ctgctgtacc taccagtgag aggtcgtgag
1741 acgtacgaga tgttgctgaa gatcaaagag tcactggagc tcatgcagta cctccctcag
1801 cacacgatcg aaacgtacag gcagcagcag cagcagcagc accagcacct acttcagaaa
1861 catctccttt cagcctgctt caggaatgag cttgtggagc cccggggaga agctccgaca
1921 cagtctgacg tcttctttag acattccaac cccccaaacc actccgtgta cccataggtc
1981 cccagctatg tgtttgagtt catgtgcttg ttgtgtttct gtgtgcgttt gtgtatatgc
2041 acatgcgtgt tagtgtttcc agccctcaca aacaggactt gaagacattt tggctcagag
2101 acccagctgc tcaaaggcac acatccacta gtgagagaat ctttgaaggg actcaaaatt
2161 ttacaaagca gagatgcttt ctgcacattt tgtatcttta gatcctgcct tggttggacg
2221 ggagccgcga ctgtgcttgt ctgtgagctt tctattgttt tcccaggagg gagggggaat
2281 ccattgggaa agaggcattg caaagtttat tggaaacctt ttctgttacc tcctgttgtg
2341 tttctaaaac tcataataaa gcttttgagc aggtctcaaa
```

SEQ ID NO: 48 Mouse p63 Isoform C Amino Acid Sequence (NP_001120733.1)

```
  1 mnfetsrcat lqycpdpyiq rfietpahfs wkesyyrsam sqstqtsefl spevfqhiwd
 61 fleqpicsvq pielnfvdep sengatnkie ismdcirmqd sdlsdpmwpq ytnlgllnsm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdsakn gdafrqnthg iqmtsikkrr spddellylp vrgretyeml lkikeslelm
421 qylpqhtiet yrqqqqqhq hllqkhllsa cfrnelvepr geaptqsdvf frhsnppnhs
481 vyp
```

SEQ ID NO: 49 Mouse p63 transcript variant 6 mRNA Sequence (NM_001127262.1; CDS: 145-1530)

```
   1 agagagagag agagagagag gcacctgaat tctgttatct tcttagaaga ttcgcagcgc
  61 aaggctctca gaggggggtgg gggggctggc aaaaccctgg aagcagaaaa gaggagagca
 121 gccttgacca gtctcactgc taacatgttg tacctggaaa acaatgccca gactcaattt
 181 agtgagccac agtacacgaa cctggggctc ctgaacagca tggaccagca gattcagaac
 241 ggctcctcgt ccaccagccc ctacaacaca gaccacgcac agaatagcgt gacggcgccc
 301 tcgccctatg cacagcccag ctccaccttt gatgccctct ctccatcccc tgccattccc
 361 tccaacacag attacccggg cccacacagc ttcgatgtgt ccttccagca gtcaagcact
 421 gccaagtcag ccacctggac gtattccacc gaactgaaga agctgtactg ccagattgcg
 481 aagacatgcc ccatccagat caaggtgatg accccacccc cacagggcgc tgttatccgt
 541 gccatgcctg tctacaagaa agctgagcat gtcaccgagg ttgtgaaacg atgccctaac
 601 catgagctga gccgtgagtt caatgaggga cagattgccc ctcccagtca tctgattcga
 661 gtagaaggga acagccatgc ccagtatgta gaagatccta tcacgggaag gcagagcgtg
 721 ctggtccctt atgagccacc acaggttggc actgaattca caacagtcct gtacaatttc
 781 atgtgtaaca gcagctgcgt cggaggaatg aacagacgtc caattttaat catcgttact
 841 ctggaaacca gagatgggca agtcctgggc cgacggtgct ttgaggcccg gatctgtgct
 901 tgcccaggaa gagaccggaa ggcagatgaa gacagcatca gaaagcagca agtatcggac
 961 agcgcaaaga acggcgatgg tacgaagcgc cctttccgtc agaatacaca cggaatccag
1021 atgacttcca tcaagaaacg gagatcccca gatgatgagc tgctgtacct accagtgaga
1081 ggtcgtgaga cgtacgagat gttgctgaag atcaaagagt cactggagct catgcagtac
1141 ctccctcagc acacgatcga aacgtacagg cagcagcagc agcagcagca ccagcaccta
1201 cttcagaaac agacctcgat gcagtctcag tcttcatatg gcaacagttc cccacctctg
1261 aacaaaatga acagcatgaa caagctgcct tccgtgagcc agcttatcaa cccacagcag
1321 cgcaatgccc tcactcccac caccatgcct gagggcatgg gagccaacat tcctatgatg
1381 ggcactcaca tgccaatggc tggagacatg aatggactca gccctaccca agctctccct
1441 cctccactct ccatgccctc cacctcccac tgcaccccac caccgcccta ccccacagac
1501 tgcagcattg tcaggatttg gcaagtctga agatccctga acagttccga catgccatct
1561 ggaagggcat cctggaccac aggcagctgc acgacttctc ctcacctcct catctcctga
1621 ggaccccaag tggtgcctct accgtcagtg tgggctccag tgagacccgt ggtgaacgtg
1681 tgatcgatgc cgtgcgcttt accctccgcc agaccatctc ttttccaccc cgtgacgagt
1741 ggaatgattt caactttgac atggattctc gtcgcaacaa gcagcagcgt atcaaagagg
1801 aaggagaatg agcgcccatt gcggggttct tcctgtcttc ttccacctcc cagcccctac
1861 agggcacgcc tgcttgatcc tcagagcctt ctcgttagct cttctccttc tccttctcag
1921 tctggtttct aaagggacgg agaattagga ggctgcctgt tacctaaagt ctgacctgtc
1981 acctgattct gattctggct ttaagccttc aatactcttg cttgcaagat gcattgacat
```

TABLE 1-continued

```
2041 tgctagatag aagttagcaa agaagcagta ggtctcttta agcagtggag atctctcatt
2101 gacttttata aagcattttc agccttatag tctaagacta tatatataaa tatataaata
2161 tccgatatat attttgggtg tggggggtat tgagtattgt ttaaatgtaa tttaatggaa
2221 attgagttgc acttatcatc cttctttgga atttgcttgt ttcggatggc tgagctgtac
2281 tcctttctca ggggtatcat gtatggtgac agatatctag agttgaatgg tctatgtgag
2341 taacaatgac gtataggacc tctcctcatc ctttggatgg ttattgttta gcacatcaaa
2401 cctgtggatg catccagtgt gtttaccatt gcttcctatg aggtaaaact gtatatatgt
2461 acacagtttt ctctgtcagt atattttatg ttactggtgt ccattccagt taggctggtt
2521 cactctgtgg ctattacaag ccacatttta ggtttgcttt gtcacacact ataagacagg
2581 gcattgtctc ttgcttttgt ttgagaatga ggaatgcagt tgtgttgtgg tttgttttgt
2641 tttattttgt tttgtttcct ggaaactctt aaatggttca agtcagccat tccaaatatc
2701 tgatgaaatt tagcccaata tagcagtagc tctttgaaat ttaaggccca acaccctagt
2761 atttattaga aaaataaaca tttgctgttg ttagaatagt cttaaaaata aatttctctg
2821 ctagattgac taagtaaaat agacattctc tgctgttgtg agaatttggg ccaattagaa
2881 tgaatgaaat tcgtctagtt ttcatgggga gttgtaatgt ctattagaaa gattcaggaa
2941 aaataagaat gattcagaaa tactgaattt ccatgaaaag gaaaacagaa agcgattcat
3001 cccaccaaac tctgaattga agttcctttt gaagggtgga gtgatgcttg ggaagtggac
3061 cttttaaaga ctttcctatc tatgagacac tgcatgcaca ggcaagtttc tctctcccca
3121 agggctaaaa taagaataat ggcttggaaa atacaaactt cgtagtgtag ttttcacata
3181 gcatgagctg aaccactgtt atcttcctct tgatcatcaa agcttcattg ttttagaaag
3241 cagaggtgaa gacccagttt tccgcctgac actttccaag ctagtgtaga ccaagacctg
3301 tctacaaacc cacgacaaac cttttcacct gtttaatcca tatccagaaa gacttgtttc
3361 ataccttggg aaagcatgca acagtattcc ccttagatat tttggaaaca ttttgagaca
3421 agtatatttt ttttcctgcc taaaccaagt gttgtttgta tgctaatgag ctctacaatc
3481 ttcccacaca ttttgttaaa tgactttcat tgcacatgag ctcccatttt ttattttaaa
3541 gtgcaaatgg gctaataggc ctttgacgtg taatgtatga gttttgccag aaaatcatat
3601 cttgtgtata tgcgtgtgtg tgaaattgct tactatgctg gttttgtttg ttatggcttt
3661 ctctttggga tagttgggtt ttccagaacc acagatgaaa ctttttttgt tgctattttt
3721 atatttttgc agaaacaccg tttagtgaga attcaatgtc aaatatgaca tgatacctta
3781 attgtaagaa gaaggtggga agggaaagtt ggtttattaa ttttttttaaa ttttgtatgc
3841 aaaagcaaat gagtccttaa tttcaacatt ttgttgtgtt taaataatga taagcatcat
3901 taacttctgt aacaaactca cagctttaca aattcaatgg gtggagaaga aagctgtgtc
3961 ttagccatgt taggaagaca aatggcttcc tgtgtgttgt aagtatttgg gctgtttcag
4021 cagtgttggt gtggcacagg ggactctgtg gcatttcagc actatttagg tggcactagg
4081 gactctgaaa ttcctgtact gtatctgatg attttggcat tagccatagg taggcacagt
4141 ttgtctcctc acaccagtgt ttagtgtgtg aatagccaga gctgtgggga agaacacaga
4201 gaacagacat ctgctggatg cctctcagtg gagaatggga ttccttcact tggtggtgaa
4261 gcagatagga tagaaagcag gattctcttt gttaatccag ttagcttttg ttttcttgat
4321 atcccccctg aatacgttga gtatgagaga tatgtgggtt ttttttattt ttataattgt
4381 acaaaattaa gcaaatatca aatgttttat atactttatt aatgtttttt ttcaaaaggt
4441 actttcttat agacatgata ctttttttaca gcttcagttg cttgtcttct ggtatttttg
4501 tgttatgggc tatggtgagc cagaggcaaa tctataagcc atttttgttt gccaggacat
4561 gcaataaaat ttaaaaaataa atgaaaatac actgaaaaaa aaaaaaaaaa aaaaaaaaaa
4621 aaaaa
```

SEQ ID NO: 50 Mouse p63 Isoform F Amino Acid Sequence (NP_001120734.1)

```
  1 mlylennaqt qfsepqytnl gllnsmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgteftttvly nfmcnsscvg gmnrrpilii vtletrdgqv
241 lgrrcfeari cacpgrdrka dedsirkqqv sdsakngdgt krpfrqnthg iqmtsikkrr
301 spddellylp vrgretyeml lkikeslelm qylpqhtiet yrqqqqqhq hllqkqtsmq
361 sqssygnssp plnkmnsmnk lpsysqlinp qqrnaltptt mpegmganip mmgthmpmag
421 dmnglsptqa lppplsmpst shctppppyp tdcsivriwq v
```

SEQ ID NO: 51 Mouse p63 transcript variant 7 mRNA Sequence (NM_001127263.1; CDS: 145-1326)

```
   1 agagagagag agagagagag gcacctgaat tctgttatct tcttagaaga ttcgcagcgc
  61 aaggctctca gagggggtgg gggggctggc aaaaccctgg aagcagaaaa gaggagagca
 121 gccttgacca gtctcactgc taacatgttg tacctggaaa acaatgccca gactcaattt
 181 agtgagccac agtacacgaa cctggggctc ctgaacagca tggaccagca gattcagaac
 241 ggctcctcgt ccaccagccc ctacaacaca gaccacgcac agaatagcgt gacggcgccc
 301 tcgccctatg cacagcccag ctccaccttt gatgccctct ctccatcccc tgccattccc
 361 tccaacacag attacccggg cccacacagc ttcgatgtgt ccttccagca gtcaagcact
 421 gccaagtcag ccacctggac gtattccacc gaactgaaga agctgtactg ccagattgcg
 481 aagacatgcc ccatccagat caaggtgatg accccacccc cacagggcgc tgttatccgt
 541 gccatgcctg tctacaagaa agctgagcat gtcaccgagg ttgtgaaacg atgccctaac
 601 catgagctga gccgtgagtt caatgaggga cagattgccc ctcccagtca tctgattcga
 661 gtagaaggga acagccatgc ccagtatgta gaagatccta tcacgggaag gcagagcgtg
 721 ctggtccctt atgagccacc acaggttggc actgaattca caacagtcct gtacaatttc
 781 atgtgtaaca gcagctgcgt cggaggaatg aacagacgtc caattttaat catcgttact
 841 ctggaaacca gagatgggca agtcctgggc cgacggtgct ttgaggcccg gatctgtgct
 901 tgcccaggaa gagaccggaa ggcagatgaa gacagcatca gaaagcagca agtatcggac
 961 agcgcaaaga acggcgatgg tacgaagcgc cctttccgtc agaatacaca cggaatccag
1021 atgacttcca tcaagaaacg gagatcccca gatgatgagc tgctgtacct accagtgaga
1081 ggtcgtgaga cgtacgagat gttgctgaag atcaaagagt cactggagct catgcagtac
1141 ctccctcagc acacgatcga aacgtacagg cagcagcagc agcagcagca ccagcaccta
1201 cttcagaaac atctcctttc agcctgcttc aggaatgagc ttgtggagcc ccggggagaa
1261 gctccgacac agtctgacgt cttctttaga cattccaacc ccccaaacca ctccgtgtac
1321 ccataggtcc ccagctatgt gtttgagttc atgtgcttgt tgtgtttctg tgtgcgtttg
```

TABLE 1-continued

```
1381 tgtatatgca catgcgtgtt agtgtttcca gccctcacaa acaggacttg aagacatttt
1441 ggctcagaga cccagctgct caaaggcaca catccactag tgagagaatc tttgaaggga
1501 ctcaaaattt tacaaagcag agatgctttc tgcacatttt gtatctttag atcctgcctt
1561 ggttggacgg gagccgcgac tgtgcttgtc tgtgagcttt ctattgtttt cccaggaggg
1621 agggggaatc cattgggaaa gaggcattgc aaagtttatt ggaaaccttt tctgttacct
1681 cctgttgtgt ttctaaaact cataataaag cttttgagca ggtctcaaa
```

SEQ ID NO: 52 Mouse p63 Isoform G Amino Acid Sequence (NP_001120735.1)

```
  1 mlylennaqt qfsepqytnl gllnsmdqqi qngsssts py ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdsakngdgt krpfrqnthg iqmtsikkrr
301 spddellylp vrgretyeml lkikeslelm qylpqhtiet yrqqqqqhq hllqkhllsa
361 cfrnelvepr geaptqsdvf frhsnppnhs vyp
```

SEQ ID NO: 53 Mouse p63 transcript variant 5 mRNA Sequence (NM_001127264.1; CDS: 145-1893)

```
   1 agagagagag agagagagag gcacctgaat tctgttatct tcttagaaga ttcgcagcgc
  61 aaggctctca gagggggtgg gggggctggc aaaaccctgg aagcagaaaa gaggagagca
 121 gccttgacca gtctcactgc taacatgttg tacctggaaa acaatgccca gactcaattt
 181 agtgagccac agtacacgaa cctggggctc ctgaacagca tggaccagca gattcagaac
 241 ggctcctcgt ccaccagccc ctacaacaca gaccacgcac agaatagcgt gacggcgccc
 301 tcgccctatg cacagcccag ctccaccttt gatgccctct ctccatcccc tgccattccc
 361 tccaacacag attacccggg cccacacagc ttcgatgtgt ccttccagca gtcaagcact
 421 gccaagtcag ccacctggac gtattccacc gaactgaaga agctgtactg ccagattgcg
 481 aagacatgcc ccatccagat caaggtgatg accccacccc cacagggcgc tgttatccgt
 541 gccatgcctg tctacaagaa agctgagcat gtcaccgagg ttgtgaaacg atgccctaac
 601 catgagctga gccgtgagtt caatgaggga cagattgccc ctcccagtca tctgattcga
 661 gtagaaggga acagccatgc ccagtatgta gaagatccta tcacgggaag gcagagcgtg
 721 ctggtccctt atgagccacc acaggttggc actgaattca caacagtcct gtacaatttc
 781 atgtgtaaca gcagctgcgt cggaggaatg aacagacgtc caattttaat catcgttact
 841 ctggaaacca gagatgggca agtcctgggc cgacggtgct ttgaggcccg gatctgtgct
 901 tgcccaggaa gagaccggaa ggcagatgaa gacagcatca gaaagcagca agtatcggac
 961 agcgcaaaga acggcgatgc tttccgtcag aatacacacg gaatccagat gacttccatc
1021 aagaaacgga gatccccaga tgatgagctg ctgtacctac cagtgagagg tcgtgagacg
1081 tacgagatgt tgctgaagat caaagagtca ctggagctca tgcagtacct ccctcagcac
1141 acgatcgaaa cgtacaggca gcagcagcag cagcagcacc agcacctact tcagaaacag
1201 acctcgatgc agtctcagtc ttcatatggc aacagttccc cacctctgaa caaaatgaac
1261 agcatgaaca agctgccttc cgtgagccag cttatcaacc cacagcagcg caatgccctc
1321 actcccacca ccatgcctga gggcatggga gccaacattc ctatgatggg cactcacatg
1381 ccaatggctg gagacatgaa tggactcagc cctacccaag ctctccctcc tccactctcc
1441 atgccctcca cctcccactg caccccacca ccgccctacc ccacagactg cagcattgtc
1501 agtttcttag caaggttggg ctgctcatca tgcctggact atttcacgac ccagggggctg
1561 accaccatct atcagattga gcattactcc atggatgatt tggcaagtct gaagatccct
1621 gaacagttcc gacatgccat ctggaagggc atcctggacc acaggcagct gcacgacttc
1681 tcctcacctc ctcatctcct gaggacccca agtggtgcct ctaccgtcag tgtgggctcc
1741 agtgagaccc gtggtgaacg tgtgatcgat gccgtgcgct ttaccctccg ccagaccatc
1801 tcttttccac cccgtgacga gtggaatgat ttcaactttg acatggattc tcgtcgcaac
1861 aagcagcagc gtatcaaaga ggaaggagaa tgagcgccca ttgcggggtt cttcctgtct
1921 tcttccacct cccagcccct acagggcacg cctgcttgat cctcagagcc ttctcgttag
1981 ctcttctcct tctccttctc agtctggttt ctaaagggac ggagaattag gaggctgcct
2041 gttacctaaa gtctgacctg tcacctgatt ctgattctgg ctttaagcct tcaatactct
2101 tgcttgcaag atgcattgac attgctagat agaagttagc aaagaagcag taggtctctt
2161 taagcagtgg agatctctca ttgactttta taaagcattt tcagccttat agtctaagac
2221 tatatatata aatatataaa tatccgatat atattttggg tgtgggggt attgagtatt
2281 gtttaaatgt aatttaatgg aaattgagtt gcacttatca tccttctttg gaatttgctt
2341 gtttcggatg gctgagctgt actcctttct caggggtatc atgtatggtg acagatatct
2401 agagttgaat ggtctatgtg agtaacaatg acgtatagga cctctcctca tcctttggat
2461 ggttattgtt tagcacatca aacctgtgga tgcatccagt gtgtttacca ttgcttccta
2521 tgaggtaaaa ctgtatatat gtacacagtt ttctctgtca gtatatttta tgttactggt
2581 gtccattcca gttaggctgg ttcactctgt ggctattaca agccacattt taggtttgct
2641 ttgtcacaca ctataagaca gggcattgtc tcttgctttt gtttgagaat gaggaatgca
2701 gttgtgttgt ggtttgtttt gttttatttt gttttgtttt ctggaaactc ttaaatggtt
2761 caagtcagcc attccaaata tctgatgaaa tttagcccaa tatagcagta gctctttgaa
2821 atttaaggcc caacacccta gtatttatta gaaaaataaa catttgctgt tgttagaata
2881 gtcttaaaaa taaatttctc tgctagattg actaagtaaa atagacattc tctgctgttg
2941 tgagaatttg ggccaattag aatgaatgaa attcgtctag ttttcatggg gagttgtaat
3001 gtctattaga aagattcagg aaaaataaga atgattcaga aatactgaat ttccatgaaa
3061 aggaaaacag aaagcgattc atcccaccaa actctgaatt gaagttcctt ttgaagggtg
3121 gagtgatgct tgggaagtgg acctttttaaa gactttccta tctatgagac actgcatgca
3181 caggcaagtt tctctctccc caagggctaa aataagaata atggcttgga aaatacaaac
3241 ttcgtagtgt agttttcaca tagcatgagc tgaaccactg ttatcttcct cttgatcatc
3301 aaagcttcat tgttttagaa agcagaggtg aagacccagt tttccgcctg acactttcca
3361 agctagtgta gaccaagacc tgtctacaaa cccacgacaa accttttcac ctgtttaatc
3421 catatccaga aagacttgtt tcataccttg ggaaagcatg caacagtatt ccccttagat
3481 atttggaaa cattttgaga caagtatatt ttttttcctg cctaaaccaa gtgttgtttg
3541 tatgctaatg agctctacaa tcttcccaca cattttgtta aatgactttc attgcacatg
3601 agctcccatt ttttatttta aagtgcaaat gggctaatag gcctttgacg tgtaatgtat
3661 gagttttgcc agaaaatcat atcttgtgta tatgcgtgtg tgtgaaattg cttactatgc
```

TABLE 1-continued

```
3721 tggttttgtt tgttatggct ttctctttgg gatagttggg ttttccagaa ccacagatga
3781 aacttttttt gttgctattt ttatattttt gcagaaacac cgtttagtga gaattcaatg
3841 tcaaatatga catgatacct taattgtaag aagaaggtgg gaagggaaag ttggtttatt
3901 aatttttta aattttgtat gcaaaagcaa atgagtcctt aatttcaaca ttttgttgtg
3961 tttaaataat gataagcatc attaacttct gtaacaaact cacagcttta caaattcaat
4021 gggtggagaa gaaagctgtg tcttagccat gttaggaaga caaatggctt cctgtgtgtt
4081 gtaagtattt gggctgtttc agcagtgttg gtgtggcaca ggggactctg tggcatttca
4141 gcactattta ggtggcacta gggactctga aattcctgta ctgtatctga tgattttggc
4201 attagccata ggtaggcaca gtttgtctcc tcacaccagt gtttagtgtg tgaatagcca
4261 gagctgtggg gaagaacaca gagaacagac atctgctgga tgcctctcag tggagaatgg
4321 gattccttca cttggtggtg aagcagatag gatagaaagc aggattctct ttgttaatcc
4381 agttagcttt tgttttcttg atatcccccc tgaatacgtt gagtatgaga gatatgtggg
4441 tttttttat ttttataatt gtacaaaatt aagcaaatat caaatgtttt atatacttta
4501 ttaatgtttt ttttcaaaag gtactttctt atagacatga tactttttta cagcttcagt
4561 tgcttgtctt ctggtatttt tgtgttatgg gctatggtga gccagaggca aatctataag
4621 ccatttttgt ttgccaggac atgcaataaa atttaaaaat aaatgaaaat acactgaaaa
4681 aaaaaaaaaa aaaaaaaaaa aaaaaaa
```

SEQ ID NO: 54 Mouse p63 Isoform E Sequence (NP_001120736.1)

```
  1 mlylennaqt qfsepqytnl gllnsmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdsakngdaf rqnthgiqmt sikkrrspdd
301 ellylpvrgr etyemllkik eslelmqylp qhtietyrqq qqqhqhllq kqtsmqsqss
361 ygnssppInk mnsmnklpsv sqlinpqqrn altpttmpeg mganipmmgt hmpmagdmng
421 lsptqalppp lsmpstshct ppppyptdcs ivsflarlgc sscldyfttq glttiyqieh
481 ysmddlaslk ipeqfrhaiw kgildhrqlh dfssphllr tpsgastvsv gssetrgerv
541 idavrftlrq tisfpprdew ndfnfdmdsr rnkqqrikee ge
```

SEQ ID NO: 55 Mouse p63 transcript variant 8 mRNA Sequence (NM_001127265.1; CDS: 145-1314)

```
   1 agagagagag agagagagag gcacctgaat tctgttatct tcttagaaga ttcgcagcgc
  61 aaggctctca gagggggtgg gggggctggc aaaaccctgg aagcagaaaa gaggagagca
 121 gccttgacca gtctcactgc taacatgttg tacctggaaa acaatgccca gactcaattt
 181 agtgagccac agtacacgaa cctggggctc ctgaacagca tggaccagca gattcagaac
 241 ggctcctcgt ccaccagccc ctacaacaca gaccacgcac agaatagcgt gacggcgccc
 301 tcgccctatg cacagcccag ctccaccttt gatgccctct ctccatcccc tgccattccc
 361 tccaacacag attacccggg cccacacagc ttcgatgtgt ccttccagca gtcaagcact
 421 gccaagtcag ccacctggac gtattccacc gaactgaaga agctgtactg ccagattgcg
 481 aagacatgcc ccatccagat caaggtgatg accccacccc cacagggcgc tgttatccgt
 541 gccatgcctg tctacaagaa agctgagcat gtcaccgagg ttgtgaaacg atgccctaac
 601 catgagctga gccgtgagtt caatgaggga cagattgccc ctcccagtca tctgattcga
 661 gtagaaggga acagccatgc ccagtatgta gaagatccta tcacgggaag gcagagcgtg
 721 ctggtccctt atgagccacc acaggttggc actgaattca caacagtcct gtacaatttc
 781 atgtgtaaca gcagctgcgt cggaggaatg aacagacgtc caattttaat catcgttact
 841 ctggaaacca gagatgggca agtcctgggc cgacggtgct ttgaggcccg gatctgtgct
 901 tgcccaggaa gagaccggaa ggcagatgaa gacagcatca gaaagcagca agtatcggac
 961 agcgcaaaga acggcgatgc tttccgtcag aatacacacg gaatccagat gacttccatc
1021 aagaaacgga gatccccaga tgatgagctg ctgtacctac cagtgagagg tcgtgagacg
1081 tacgagatgt tgctgaagat caaagagtca ctggagctca tgcagtacct ccctcagcac
1141 acgatcgaaa cgtacaggca gcagcagcag cagcagcacc agcacctact tcagaaacat
1201 ctcctttcag cctgcttcag gaatgagctt gtggagcccc ggggagaagc tccgacacag
1261 tctgacgtct tctttagaca ttccaacccc ccaaaccact ccgtgtaccc ataggtcccc
1321 agctatgtgt ttgagttcat gtgcttgttg tgtttctgtg tgcgtttgtg tatatgcaca
1381 tgcgtgttag tgtttccagc cctcacaaac aggacttgaa gacattttgg ctcagagacc
1441 cagctgctca aaggcacaca tccactagtg agagaatctt tgaagggact caaaatttta
1501 caaagcagag atgctttctg cacattttgt atctttagat cctgccttgg ttggacggga
1561 gccgcgactg tgcttgtctg tgagctttct attgttttcc caggagggag ggggaatcca
1621 ttgggaaaga ggcattgcaa agtttattgg aaacctttc tgttacctcc tgttgtgttt
1681 ctaaaactca taataaagct tttgagcagg tctcaaa
```

SEQ ID NO: 56 Mouse p63 Isoform H Amino Acid Sequence (NP_001120737.1)

```
  1 mlylennaqt qfsepqytnl gllnsmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdsakngdaf rqnthgiqmt sikkrrspdd
301 ellylpvrgr etyemllkik eslelmqylp qhtietyrqq qqqhqhllq khllsacfrn
361 elveprgeap tqsdvffrhs nppnhsvyp
```

SEQ ID NO: 57 Mouse p63 transcript variant 4 mRNA Sequence (NM_011641.2; CDS: 145-1905)

```
  1 agagagagag agagagagag gcacctgaat tctgttatct tcttagaaga ttcgcagcgc
 61 aaggctctca gagggggtgg gggggctggc aaaaccctgg aagcagaaaa gaggagagca
121 gccttgacca gtctcactgc taacatgttg tacctggaaa acaatgccca gactcaattt
181 agtgagccac agtacacgaa cctggggctc ctgaacagca tggaccagca gattcagaac
241 ggctcctcgt ccaccagccc ctacaacaca gaccacgcac agaatagcgt gacggcgccc
301 tcgccctatg cacagcccag ctccaccttt gatgccctct ctccatcccc tgccattccc
361 tccaacacag attacccggg cccacacagc ttcgatgtgt ccttccagca gtcaagcact
```

TABLE 1-continued 421 gccaagtcag ccacctggac gtattccacc gaactgaaga agctgtactg ccagattgcg
481 aagacatgcc ccatccagat caaggtgatg accccacccc cacagggcgc tgttatccgt
541 gccatgcctg tctacaagaa agctgagcat gtcaccgagg ttgtgaaacg atgccctaac
601 catgagctga gccgtgagtt caatgaggga cagattgccc ctcccagtca tctgattcga
661 gtagaaggga acagccatgc ccagtatgta gaagatccta tcacgggaag gcagagcgtg
721 ctggtccctt atgagccacc acaggttggc actgaattca caacagtcct gtacaatttc
781 atgtgtaaca gcagctgcgt cggaggaatg aacagacgtc caattttaat catcgttact
841 ctggaaacca gagatgggca agtcctgggc cgacggtgct ttgaggcccg gatctgtgct
901 tgcccaggaa gagaccggaa ggcagatgaa gacagcatca gaaagcagca agtatcggac
961 agcgcaaaga acggcgatgg tacgaagcgc cctttccgtc agaatacaca cggaatccag
1021 atgacttcca tcaagaaacg gagatcccca gatgatgagc tgctgtacct accagtgaga
1081 ggtcgtgaga cgtacgagat gttgctgaag atcaaagagt cactggagct catgcagtac
1141 ctccctcagc acacgatcga aacgtacagg cagcagcagc agcagcagca ccagcaccta
1201 cttcagaaac agacctcgat gcagtctcag tcttcatatg gcaacagttc cccacctctg
1261 aacaaaatga acagcatgaa caagctgcct tccgtgagcc agcttatcaa cccacagcag
1321 cgcaatgccc tcactcccac caccatgcct gagggcatgg gagccaacat tcctatgatg
1381 ggcactcaca tgccaatggc tggagacatg aatggactca gccctaccca agctctccct
1441 cctccactct ccatgccctc cacctcccac tgcaccccac caccgcccta ccccacagac
1501 tgcagcattg tcagtttctt agcaaggttg ggctgctcat catgcctgga ctatttcacg
1561 acccaggggc tgaccaccat ctatcagatt gagcattact ccatggatga tttggcaagt
1621 ctgaagatcc ctgaacagtt ccgacatgcc atctggaagg gcatcctgga ccacaggcag
1681 ctgcacgact tctcctcacc tcctcatctc ctgaggaccc caagtggtgc ctctaccgtc
1741 agtgtgggct ccagtgagac ccgtggtgaa cgtgtgatcg atgccgtgcg ctttaccctc
1801 cgccagacca tctcttttcc accccgtgac gagtggaatg atttcaactt tgacatggat
1861 tctcgtcgca acaagcagca gcgtatcaaa gaggaaggag aatgagcgcc cattgcgggg
1921 ttcttcctgt cttcttccac ctcccagccc ctacagggca cgcctgcttg atcctcagag
1981 ccttctcgtt agctcttctc cttctccttc tcagtctggt ttctaaaggg acggagaatt
2041 aggaggctgc ctgttaccta aagtctgacc tgtcacctga ttctgattct ggctttaagc
2101 cttcaatact cttgcttgca agatgcattg acattgctag atagaagtta gcaaagaagc
2161 agtaggtctc tttaagcagt ggagatctct cattgacttt tataaagcat tttcagcctt
2221 atagtctaag actatatata taaatatata aatatccgat atatatttttg ggtgtggggg
2281 gtattgagta ttgtttaaat gtaatttaat ggaaattgag ttgcacttat catccttctt
2341 tggaatttgc ttgtttcgga tggctgagct gtactccttt ctcaggggta tcatgtatgg
2401 tgacagatat ctagagttga atggtctatg tgagtaacaa tgacgtatag gacctctcct
2461 catcctttgg atggttattg tttagcacat caaacctgtg gatgcatcca gtgtgtttac
2521 cattgcttcc tatgaggtaa aactgtatat atgtacacag ttttctctgt cagtatattt
2581 tatgttactg gtgtccattc cagttaggct ggttcactct gtggctatta caagccacat
2641 tttaggtttg ctttgtcaca cactataaga cagggcattg tctcttgctt ttgtttgaga
2701 atgaggaatg cagttgtgtt gtggtttgtt ttgttttatt ttgttttgtt ttctggaaac
2761 tcttaaatgg ttcaagtcag ccattccaaa tatctgatga aatttagccc aatatagcag
2821 tagctctttg aaatttaagg cccaacaccc tagtatttat tagaaaaata aacatttgct
2881 gttgttagaa tagtcttaaa aataaatttc tctgctagat tgactaagta aaatagacat
2941 tctctgctgt tgtgagaatt tgggccaatt agaatgaatg aaattcgtct agttttcatg
3001 gggagttgta atgtctatta gaaagattca ggaaaaataa gaatgattca gaaatactga
3061 atttccatga aaaggaaaac agaaagcgat tcatcccacc aaactctgaa ttgaagttcc
3121 ttttgaaggg tggagtgatg cttgggaagt ggacctttta aagactttcc tatctatgag
3181 acactgcatg cacaggcaag tttctctctc cccaagggct aaaataagaa taatggcttg
3241 gaaaatacaa acttcgtagt gtagttttca catagcatga gctgaaccac tgttatcttc
3301 ctcttgatca tcaaagcttc attgttttag aaagcagagg tgaagaccca gttttccgcc
3361 tgacactttc caagctagtg tagaccaaga cctgtctaca aacccacgac aaacctttttc
3421 acctgtttaa tccatatcca gaaagacttg tttcatacct tgggaaagca tgcaacagta
3481 ttccccttag atattttgga aacattttga gacaagtata ttttttttcc tgcctaaacc
3541 aagtgttgtt tgtatgctaa tgagctctac aatcttccca cacattttgt taaatgactt
3601 tcattgcaca tgagctccca ttttttattt taaagtgcaa atgggctaat aggcctttga
3661 cgtgtaatgt atgagttttg ccagaaaatc atatcttgtg tatatgcgtg tgtgtgaaat
3721 tgcttactat gctggttttg tttgttatgg ctttctcttt gggatagttg ggttttccag
3781 aaccacagat gaaacttttt ttgttgctat ttttatattt ttgcagaaac accgtttagt
3841 gagaattcaa tgtcaaatat gacatgatac cttaattgta agaagaaggt gggaagggaa
3901 agttggttta ttaatttttt taaattttgt atgcaaaagc aaatgagtcc ttaatttcaa
3961 catttgttg tgtttaaata atgataagca tcattaactt ctgtaacaaa ctcacagctt
4021 tacaaattca atgggtggag aagaaagctg tgtcttagcc atgttaggaa gacaaatggc
4081 ttcctgtgtg ttgtaagtat ttgggctgtt tcagcagtgt tggtgtggca caggggactc
4141 tgtggcattt cagcactatt taggtggcac tagggactct gaaattcctg tactgtatct
4201 gatgattttg gcattagcca taggtaggca cagtttgtct cctcacacca gtgtttagtg
4261 tgtgaatagc cagagctgtg gggaagaaca cagagaacag acatctgctg gatgcctctc
4321 agtggagaat gggattcctt cacttggtgg tgaagcagat aggatagaaa gcaggattct
4381 ctttgttaat ccagttagct tttgttttct tgatatcccc cctgaatacg ttgagtatga
4441 gagatatgtg ggttttttttt atttttataa ttgtacaaaa ttaagcaaat atcaaatgtt
4501 ttatatactt tattaatgtt ttttttcaaa aggtactttc ttatagacat gatacttttt
4561 tacagcttca gttgcttgtc ttctggtatt tttgtgttat gggctatggt gagccagagg
4621 caaatctata agccattttt gtttgccagg acatgcaata aaatttaaaa ataaatgaaa
4681 atacactgaa aaaaaaaaaa aaaaaaaaaa SEQ ID NO: 58 Mouse p63 Isoform D Amino Acid Sequence (NP_035771.1)
1 mlylennaqt qfsepqytnl gllnsmdqqi qngssstspy ntdhaqnsvt apspyaqpss
61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdsakngdgt krpfrqnthg iqmtsikkrr
301 spddellylp vrgretyeml lkikeslelm qylpqhtiet yrqqqqqhq hllqkqtsmq TABLE 1-continued

```
 361 sqssygnssp plnkmnsmnk lpsysqlinp qqrnaltptt mpegmganip mmgthmpmag
 421 dmnglsptqa lppplsmpst shctppppyp tdcsivsfla rlgcsscldy fttqglttiy
 481 qiehysmddl aslkipeqfr haiwkgildh rqlhdfsspp hllrtpsgas tvsvgssetr
 541 gervidavrf tlrqtisfpp rdewndfnfd mdsrrnkqqr ikeege
```

SEQ ID NO: 59 Rat p63 transcript variant 1 Sequence (NM_019221.3; CDS: 148-2190)

```
   1 ggggggaagt gtctaaactt ctatgtctga tggcatttga ccctattgct ttcagcctcc
  61 tggctatata cctagatatt ctcaggtgta tatgtatatt ttatagaatt gttccccatc
 121 tgttggtatc aaagagagtt gaaggaaatg aattttgaaa cttcacggtg tgctacccta
 181 cagtactgcc ctgaccctta catccagcgt ttcatagaaa ccccatctca tttctcctgg
 241 aaagaaagtt attaccggtc cgccatgtcg cagagcaccc agacaagtga gttcctcagc
 301 ccagaggtgt tccagcatat ctgggatttt ctggaacagc ctatatgctc agtacagccc
 361 atcgacttga actttgtgga cgaaccatca gaaaatggtg caacaaacaa gattgagatt
 421 agcatggatt gtatccgcat gcaagactca gacctcagtg accccatgtg gccacagtac
 481 acgaacctgg ggctcctgaa cggcatggac cagcagattc agaacggctc ctcatctacc
 541 agcccctata acacagacca tgcacagaac agcgtgacgg caccctcgcc ctatgcacag
 601 cccagctcaa ccttcgatgc cctttctcca tcccctgcca ttccctccaa cacagattac
 661 ccaggcccac acagcttcga tgtgtccttc cagcagtcaa gcaccgccaa gtcagctacc
 721 tggacgtatt ccaccgaact gaagaaactc tactgccaga ttgcaaagac ctgccccatc
 781 cagatcaagg tgatgacccc acccccacag ggcgccgtca ttcgtgccat gcctgtctac
 841 aagaaagccg agcatgtcac cgaggttgtg aaacgatgtc ctaaccacga gctgagccgc
 901 gagttcaatg agggacagat tgcccctccc agtcatctga ttcgagtaga agggaacagc
 961 catgcccagt atgtagaaga tcctatcaca ggaaggcaga gcgtgctggt cccttatgag
1021 ccaccacagg ttggcactga attcacaaca gtcctgtaca atttcatgtg caacagcagc
1081 tgtgtcggag gaatgaaccg ccgtccaatt ttaatcatcg ttactctgga aaccagagat
1141 gggcaagtcc tgggccgacg ttgctttgag gcccggatct gcgcttgccc aggaagagac
1201 cggaaggccg atgaagacag catcagaaag cagcaagtat cagacagcgc aaagaacggc
1261 gatggtacga agcgcccttt ccgtcagaat acccacggaa tccagatgac ttccatcaag
1321 aaacggagat ccccagatga tgagctgctg tacctaccag tgagaggccg tgagacttat
1381 gaaatgctgc tcaagatcaa ggagtcgctc gagctcatgc agtatctccc tcagcacacg
1441 atcgagacgt acaggcagca gcagcagcag cagcaccaac acctacttca gaaacagacc
1501 tcgatgcagt ctcagtcttc atacggtaac agctcaccac ctctgaacaa aatgaacagc
1561 atgaacaagc tgccgtctgt gagccagctt atcaacccac agcagcgcaa cgccctgact
1621 cccaccacca tgcctgaggg catgggagcc aacattccta tgatgggcac tcacatgcca
1681 atggctggag acatgaatgg actcagcccc acccaagctc ttcctcctcc actctccatg
1741 ccctccacct cccactgcac ccccccacct ccgtacccaa cagactgcag cattgtcagt
1801 ttcttagcaa ggttgggctg ttcatcatgt ctggactatt tcacgaccca ggggctgacc
1861 accatctatc agattgagca ttactccatg gatgatttgg caagtctgaa gatccctgag
1921 cagttccgac atgccatctg gaagggggatc ctggaccaca ggcagctgca tgacttctcc
1981 tcacctccgc atctcctgag aacccccagt ggtgcctcta cagtcagtgt gggctccagt
2041 gagacccgtg gagaacgtgt gattgatgcc gtgcgcttta ctctccgcca gaccatctct
2101 ttcccacccc gtgatgagtg gaacgatttc aactttgaca tggattcccg tcgcaacaag
2161 cagcagcgca tcaaagagga aggagaatga acgtccgtcg ccgggttctt cctgttttct
2221 tcctcctccc agctcccaca gggcacgcct gcttgatcct caaagccttc tcgctagctc
2281 tcctcctcct ccttctcagt ctggtttcta aagggacgga gaattaagag gctacctgtt
2341 acctaaagtc tgacctgtca cctgattctg atcctggctt taagccttca atactcttgc
2401 ttgcaagatg cgttgacatt gctagataga cgttagcaga gaagcagtgg gtctctctaa
2461 gcactggaga tcgctcattg acttttataa agcattttca gccttatagt ctaagactat
2521 atatataaat atataaatat acaatatata tttcgggtgg gggtattgag tattgtttaa
2581 atgtaattta atggaaatcg agttgcactt atcaaccttc tttggaattt gcttgttttg
2641 gttggctgat ctgtacccct ttctcagggg tatcatgtat ggtgacagat atttagagtt
2701 gaatggtcta tgtgagtaac agtgatatat aggtcctctc ctttctttgg atgattgccg
2761 tttagcacat caaacctgtg gatgcgtcca gtctgtttac cattgctcct tatgaggtaa
2821 aactgcatat actgtcagtc tattttatgt tactggtgtc cattccagtt aggctggttc
2881 actctgtggc cattccaagc aaaattttat gtttgctttg tcacacacta gaagacaggg
2941 catcatctct tgcttttgtt tgagaatgag gagtactttt tttttttct ggaaaatctt
3001 aaatggtcca aatcagccat tccaaatggc tgatgaaatg tagccaatat agcagttagc
3061 tctctaaaat ttaagaccca acaccctcgt atttattagt aaaacaaaaa tgaaacattt
3121 gctgtcatta gagtagcctt aaaattaaat ttcaatacca gattgactga gtaaactatg
3181 cattcaatgt tgttgtgaga attggggcta attagtcagg atgattggaa tttgtgtagt
3241 tttttatggt gagttgcaat atctatttag gaaggttcag gaataataag aatgactcag
3301 aaatactcaa tctccgtgac aacagaaagc aatctcacca aactctgaat ttaaacccct
3361 tttgaaacat ggagtgaggc ttgggaaatg taccttttaa agactttcct atctataaga
3421 cactgcatgc aggggcaagt ttaatctctc atcaaggtgg aaaataagaa tagtagctcg
3481 gaaactacaa acttgctagt gtagctttca catggcatga gctcaactat tgttattttc
3541 ctctttatca tcaaagctcc attgctgtag aaagcagagg tgaagaccca gttttccacc
3601 tgacactttc cgggcaaggc atagaccaag aactgtctac aaaaccaggg caaagctctt
3661 cagtgaagct gtttaattca catggagaaa cacttgtttc ccactttggg aaagcatgca
3721 acagtgttcc ccctagatgt tttggaaaca ttttgagtca aatatatttt tcccagacta
3781 aaccaggcta atgagctcta caatcctcct gcacattttg gtaaagggct gtcattgcac
3841 aggagctccc atttttatct taaagtgcaa atgggctaat acgcctacga aatgtaatgt
3901 atgggttttg ccagaaaata gtatattgtg tacacgtgtc tgtgtgtgag tgtgagagtg
3961 tgtgtgtgtg tgtgtgtgtg tgtgtgtgtg aaattgcata ctatgctggt tttgtttgtt
4021 actctttctc ttggggatag ttgggttttc cagaaccaca gacgaaactt ttttttgttg
4081 ctgtttttat atttttgcag aaacaccatt tagtgagaat tcaatgtcaa attagacatg
4141 acaccttaat tgtaagaagg ggggagaggg aaagttggtt ttttttaatt ttttaaaatt
4201 ttgtatacta aagagaatga gtccttaatt tcaacattct gttgcattta aataatgata
4261 agcatcatta acttctgtaa caacttccca gcttggcaaa ttcaatgcat ggagaacaaa
4321 gctgggcctt agccatgtta gggagaaaaa tggcttcttg gggttgtga gcatttgggt
```

TABLE 1-continued

```
4381 tgctttagca ccgttgaggt ggcacagggg actcctgagg catttcagca ctacttacgt
4441 agcactaggg actcggaaat tcctgtactg tagctaatga ttttggcgtt caccattagc
4501 agtagatagg ccgtttctct cctcacacca gtgttaagcg tgtgagtagc cagagctgtg
4561 gggaagagca tggagaacag acgtctgctg gatgcctctc accggagaat gagattcctt
4621 cgcgtggtgg tgaagtagga taggaagcag gagtctcctt gttagtccag ttagctattg
4681 ttttcttgat attccccccc aaaacattga ctatgagaga tatgtggggc tttttttattt
4741 ttataattgt acaaaattaa acaaatatga aatgttttat atactttatt aatgtttttt
4801 ttcaaaaggt actttcttat agacatgatc cttttttttac aggttcagtt gcttgtccct
4861 tggtattttt gtgttatggg ctatggtgag cctgaggcaa atctataagc catttttgtt
4921 tgccaggaca tgcaataaaa tttaaaaata aatgaaaata cactgaaaaa aaaaaaaaaa
4981 aaaaaaaaaa a
```

SEQ ID NO: 60 Rat p63 Isoform A Amino Acid Sequence (NP_062094.1)

```
  1 mnfetsrcat lqycpdpyiq rfietpshfs wkesyyrsam sqstqtsefl spevfqhiwd
 61 fleqpicsvq pidlnfvdep sengatnkie ismdcirmqd sdlsdpmwpq ytnlgllngm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdsakn gdgtkrpfrq nthgiqmtsi kkrrspddel lylpvrgret yemllkikes
421 lelmqylpqh tietyrqqqq qqhqhllqkq tsmqsqssyg nssplnkmn smnklpsvsq
481 linpqqrnal tpttmpegmg anipmmgthm pmagdmngls ptqalpppls mpstshctpp
541 ppyptdcsiv sflarlgcss cldyfttqgl ttiyqiehys mddlaslkip eqfrhaiwkg
601 ildhrqlhdf ssphllrtp sgastvsvgs setrgervid avrftlrqti sfpprdewnd
661 fnfdmdsrrn kqqrikeege
```

SEQ ID NO: 61 Rat p63 transcript variant 2 Sequence (NM_0011273391; (CDS: 148-1815)

```
   1 ggggggaagt gtctaaactt ctatgtctga tggcatttga ccctattgct ttcagcctcc
  61 tggctatata cctagatatt ctcaggtgta tatgtatatt ttatagaatt gttccccatc
 121 tgttggtatc aaagagagtt gaaggaaatg aattttgaaa cttcacggtg tgctacccta
 181 cagtactgcc ctgaccctta catccagcgt ttcatagaaa ccccatctca tttctcctgg
 241 aaagaaagtt attaccggtc cgccatgtcg cagagcaccc agacaagtga gttcctcagc
 301 ccagaggtgt tccagcatat ctgggatttt ctggaacagc ctatatgctc agtacagccc
 361 atcgacttga actttgtgga cgaaccatca gaaaatggtg caacaaacaa gattgagatt
 421 agcatggatt gtatccgcat gcaagactca gacctcagtg accccatgtg gccacagtac
 481 acgaacctgg ggctcctgaa cggcatggac cagcagattc agaacggctc ctcatctacc
 541 agcccctata acacagacca tgcacagaac agcgtgacgg caccctcgcc ctatgcacag
 601 cccagctcaa ccttcgatgc cctttctcca tcccctgcca ttccctccaa cacagattac
 661 ccaggcccac acagcttcga tgtgtccttc cagcagtcaa gcaccgccaa gtcagctacc
 721 tggacgtatt ccaccgaact gaagaaactc tactgccaga ttgcaaagac ctgccccatc
 781 cagatcaagg tgatgacccc acccccacag ggcgccgtca ttcgtgccat gcctgtctac
 841 aagaaagccg agcatgtcac cgaggttgtg aaacgatgtc ctaaccacga gctgagccgc
 901 gagttcaatg agggacagat tgcccctccc agtcatctga ttcgagtaga agggaacagc
 961 catgcccagt atgtagaaga tcctatcaca ggaaggcaga gcgtgctggt cccttatgag
1021 ccaccacagg ttggcactga attcacaaca gtcctgtaca atttcatgtg caacagcagc
1081 tgtgtcggag gaatgaaccg ccgtccaatt ttaatcatcg ttactctgga aaccagagat
1141 gggcaagtcc tgggccgacg ttgctttgag gcccggatct gcgcttgccc aggaagagac
1201 cggaaggccg atgaagacag catcagaaag cagcaagtat cagacagcgc aaagaacggc
1261 gatggtacga agcgcccttt ccgtcagaat acccacggaa tccagatgac ttccatcaag
1321 aaacggagat ccccagatga tgagctgctg tacctaccag tgagaggccg tgagacttat
1381 gaaatgctgc tcaagatcaa ggagtcgctc gagctcatgc agtatctccc tcagcacacg
1441 atcgagacgt acaggcagca gcagcagcag cagcaccaac acctacttca gaaacagacc
1501 tcgatgcagt ctcagtcttc atacggtaac agctcaccac ctctgaacaa aatgaacagc
1561 atgaacaagc tgccgtctgt gagccagctt atcaacccac agcagcgcaa cgccctgact
1621 cccaccacca tgcctgaggg catgggagcc aacattccta tgatgggcac tcacatgcca
1681 atggctggag acatgaatgg actcagcccc acccaagctc ttcctcctcc actctccatg
1741 ccctccacct cccactgcac ccccccacct ccgtacccaa cagactgcag cattgtcagg
1801 atttggcaag tctgaagatc cctgagcagt tccgacatgc catctggaag gggatcctgg
1861 accacaggca gctgcatgac ttctcctcac ctccgcatct cctgagaacc cccagtggtg
1921 cctctacagt cagtgtgggc tccagtgaga cccgtggaga acgtgtgatt gatgccgtgc
1981 gctttactct ccgccagacc atctctttcc caccccgtga tgagtggaac gatttcaact
2041 ttgacatgga ttcccgtcgc aacaagcagc agcgcatcaa agaggaagga gaatgaacgt
2101 ccgtcgccgg gttcttcctg ttttcttcct cctcccagct cccacagggc acgcctgctt
2161 gatcctcaaa gccttctcgc tagctctcct cctcctcctt ctcagtctgg tttctaaagg
2221 gacggagaat taagaggcta cctgttacct aaagtctgac ctgtcacctg attctgatcc
2281 tggctttaag ccttcaatac tcttgcttgc aagatgcgtt gacattgcta gatagacgtt
2341 agcagagaag cagtgggtct ctctaagcac tggagatcgc tcattgactt ttataaagca
2401 ttttcagcct tatagtctaa gactatatat ataaatatat aaatatacaa tatatatttc
2461 gggtgggggt attgagtatt gtttaaatgt aatttaatgg aaatcgagtt gcacttatca
2521 accttctttg gaatttgctt gttttggttg gctgatctgt accccttttct caggggtatc
2581 atgtatggtg acagatattt agagttgaat ggtctatgtg agtaacagtg atatataggt
2641 cctctccttt ctttggatga ttgccgttta gcacatcaaa cctgtggatg cgtccagtct
2701 gtttaccatt gctccttatg aggtaaaact gcatatactg tcagtctatt ttatgttact
2761 ggtgtccatt ccagttaggc tggttcactc tgtggccatt ccaagcaaaa ttttatgttt
2821 gctttgtcac acactagaag acagggcatc atctcttgct tttgtttgag aatgaggagt
2881 acttttttttt ttttctggaa aatcttaaat ggtccaaatc agccattcca aatggctgat
2941 gaaatgtagc caatatagca gttagctctc taaaatttaa gacccaacac cctcgtattt
3001 attagtaaaa caaaaatgaa acatttgctg tcattagagt agccttaaaa ttaaatttca
3061 ataccagatt gactgagtaa actatgcatt caatgttgtt gtgagaattg gggctaatta
```

TABLE 1-continued

```
3121 gtcaggatga ttggaatttg tgtagttttt tatggtgagt tgcaatatct atttaggaag
3181 gttcaggaat aataagaatg actcagaaat actcaatctc cgtgacaaca gaaagcaatc
3241 tcaccaaact ctgaatttaa acccctttttg aaacatggag tgaggcttgg gaaatgtacc
3301 ttttaaagac tttcctatct ataagacact gcatgcaggg gcaagtttaa tctctcatca
3361 aggtggaaaa taagaatagt agctcggaaa ctacaaactt gctagtgtag ctttcacatg
3421 gcatgagctc aactattgtt attttcctct ttatcatcaa agctccattg ctgtagaaag
3481 cagaggtgaa gacccagttt tccacctgac actttccggg caaggcatag accaagaact
3541 gtctacaaaa ccagggcaaa gctcttcagt gaagctgttt aattcacatg gagaaacact
3601 tgtttcccac tttgggaaag catgcaacag tgttcccccct agatgttttg gaaacatttt
3661 gagtcaaata tatttttccc agactaaacc aggctaatga gctctacaat cctcctgcac
3721 atttggtaa agggctgtca ttgcacagga gctcccattt ttatcttaaa gtgcaaatgg
3781 gctaatacgc ctacgaaatg taatgtatgg gttttgccag aaaatagtat attgtgtaca
3841 cgtgtctgtg tgtgagtgtg agagtgtgtg tgtgtgtgtg tgtgtgtgtg tgtgtgaaat
3901 tgcatactat gctggttttg tttgttactc tttctcttgg ggatagttgg gttttccaga
3961 accacagacg aaactttttt ttgttgctgt ttttatattt ttgcagaaac accatttagt
4021 gagaattcaa tgtcaaatta gacatgacac cttaattgta agaaggggggg agagggaaag
4081 ttggtttttt ttaatttttt aaaattttgt atactaaaga gaatgagtcc ttaatttcaa
4141 cattctgttg catttaaata atgataagca tcattaactt ctgtaacaac ttcccagctt
4201 ggcaaattca atgcatggag aacaaagctg ggccttagcc atgttaggga gaaaaatggc
4261 ttcttggggg ttgtgagcat ttgggttgct ttagcaccgt tgaggtggca caggggactc
4321 ctgaggcatt tcagcactac ttacgtagca ctagggactc ggaaattcct gtactgtagc
4381 taatgatttt ggcgttcacc attagcagta gataggccgt ttctctcctc acaccagtgt
4441 taagcgtgtg agtagccaga gctgtgggga agagcatgga gaacagacgt ctgctggatg
4501 cctctcaccg gagaatgaga ttccttcgcg tggtggtgaa gtaggatagg aagcaggagt
4561 ctccttgtta gtccagttag ctattgtttt cttgatattc ccccccaaaa cattgactat
4621 gagagatatg tggggctttt ttatttttat aattgtacaa aattaaacaa atatgaaatg
4681 ttttatatac tttattaatg ttttttttca aaaggtactt tcttatagac atgatccttt
4741 ttttacaggt tcagttgctt gtcccttggt atttttgtgt tatgggctat ggtgagcctg
4801 aggcaaatct ataagccatt tttgtttgcc aggacatgca ataaaattta aaaataaatg
4861 aaaatacact gaaaaaaaaa aaaaaaaaaa aaaaaaa
```

SEQ ID NO: 62 Rat p63 Isoform B Amino Acid Sequence (NP_001120811.1)

```
  1 mnfetsrcat lqycpdpyiq rfietpshfs wkesyyrsam sqstqtsefl spevfqhiwd
 61 fleqpicsvq pidlnfvdep sengatnkie ismdcirmqd sdlsdpmwpq ytnlgllngm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
361 kqqvsdsakn gdgtkrpfrq nthgiqmtsi kkrrspddel lylpvrgret yemllkikes
421 lelmqylpqh tietyrqqqq qqhqhllqkq tsmqsqssyg nssppplnkmn smnklpsysq
481 linpqqrnal tpttmpegmg anipmmgthm pmagdmngls ptqalpppls mpstshctpp
541 ppyptdcsiv riwqv
```

SEQ ID NO: 63 Rat p63 transcript variant 3 Sequence (NM_001127341.1; CDS: 148 1611)

```
   1 ggggggaagt gtctaaactt ctatgtctga tggcatttga ccctattgct ttcagcctcc
  61 tggctatata cctagatatt ctcaggtgta tatgtatatt ttatagaatt gttccccatc
 121 tgttggtatc aaagagagtt gaaggaaatg aattttgaaa cttcacggtg tgctacccta
 181 cagtactgcc ctgaccctta catccagcgt ttcatagaaa ccccatctca tttctcctgg
 241 aaagaaagtt attaccggtc cgccatgtcg cagagcaccc agacaagtga gttcctcagc
 301 ccagaggtgt tccagcatat ctgggatttt ctggaacagc ctatatgctc agtacagccc
 361 atcgacttga actttgtgga cgaaccatca gaaaatggtg caacaaacaa gattgagatt
 421 agcatggatt gtatccgcat gcaagactca gacctcagtg accccatgtg gccacagtac
 481 acgaacctgg ggctcctgaa cggcatggac cagcagattc agaacggctc ctcatctacc
 541 agccccctata acacagacca tgcacagaac agcgtgacgg caccctcgcc ctatgcacag
 601 cccagctcaa ccttcgatgc cctttctcca tcccctgcca ttccctccaa cacagattac
 661 ccaggcccac acagcttcga tgtgtccttc cagcagtcaa gcaccgccaa gtcagctacc
 721 tggacgtatt ccaccgaact gaagaaactc tactgccaga ttgcaaagac ctgccccatc
 781 cagatcaagg tgatgacccc acccccacag ggcgccgtca ttcgtgccat gcctgtctac
 841 aagaaagccg agcatgtcac cgaggttgtg aaacgatgtc ctaaccacga gctgagccgc
 901 gagttcaatg agggacagat tgcccctccc agtcatctga ttcgagtaga agggaacagc
 961 catgcccagt atgtagaaga tcctatcaca ggaaggcaga gcgtgctggt cccttatgag
1021 ccaccacagg ttggcactga attcacaaca gtcctgtaca atttcatgtg caacagcagc
1081 tgtgtcggag gaatgaaccg ccgtccaatt ttaatcatcg ttactctgga aaccagagat
1141 gggcaagtcc tgggccgacg ttgctttgag gcccggatct gcgcttgccc aggaagagac
1201 cggaaggccg atgaagacag catcagaaag cagcaagtat cagacagcgc aaagaacggc
1261 gatggtacga agcgcccttt ccgtcagaat acccacggaa tccagatgac ttccatcaag
1321 aaacggagat ccccagatga tgagctgctg tacctaccag tgagaggccg tgagacttat
1381 gaaatgctgc tcaagatcaa ggagtcgctc gagctcatgc agtatctccc tcagcacacg
1441 atcgagacgt acaggcagca gcagcagcag cagcaccaac acctacttca gaaacatctc
1501 ctttcagcct gcttcaggaa tgagcttgtg gagtcccgga gagaagctcc gacacagtct
1561 gacgtcttct ttagacattc caacccccca aaccactcag tgtacccata g
```

SEQ ID NO: 64 Rat p63 Isoform C Amino Acid Sequence (NP_001120813.1)

```
  1 mnfetsrcat lqycpdpyiq rfietpshfs wkesyyrsam sqstqtsefl spevfqhiwd
 61 fleqpicsvq pidlnfvdep sengatnkie ismdcirmqd sdlsdpmwpq ytnlgllngm
121 dqqiqngsss tspyntdhaq nsvtapspya qpsstfdals pspaipsntd ypgphsfdvs
181 fqqsstaksa twtystelkk lycqiaktcp iqikvmtppp qgavirampv ykkaehvtev
241 vkrcpnhels refnegqiap pshlirvegn shaqyvedpi tgrqsvlvpy eppqvgteft
301 tvlynfmcns scvggmnrrp iliivtletr dgqvlgrrcf earicacpgr drkadedsir
```

TABLE 1-continued

```
 361 kqqvsdsakn gdgtkrpfrq nthgiqmtsi kkrrspddel lylpvrgret yemllkikes
 421 lelmqylpqh tietyrqqqq qqhqhllqkh llsacfrnel vesrreaptq sdvffrhsnp
 481 pnhsvyp

SEQ ID NO: 65 Rat p63 transcript variant 4 Sequence (NM_001127342.1; CDS: 1-
1761)
   1 atgttgtacc tggaaagcaa tgcccagact caatttagtg agccacagta cacgaacctg
  61 gggctcctga acggcatgga ccagcagatt cagaacggct cctcatctac cagcccctat
 121 aacacagacc atgcacagaa cagcgtgacg gcaccctcgc cctatgcaca gcccagctca
 181 accttcgatg ccctttctcc atcccctgcc attccctcca acacagatta cccaggccca
 241 cacagcttcg atgtgtcctt ccagcagtca agcaccgcca agtcagctac ctggacgtat
 301 tccaccgaac tgaagaaact ctactgccag attgcaaaga cctgccccat ccagatcaag
 361 gtgatgaccc caccccccaca gggcgccgtc attcgtgcca tgcctgtcta caagaaagcc
 421 gagcatgtca ccgaggttgt gaaacgatgt cctaaccacg agctgagccg cgagttcaat
 481 gagggacaga ttgcccctcc cagtcatctg attcgagtag aagggaacag ccatgcccag
 541 tatgtagaag atcctatcac aggaaggcag agcgtgctgg tcccttatga gccaccacag
 601 gttggcactg aattcacaac agtcctgtac aatttcatgt gcaacagcag ctgtgtcgga
 661 ggaatgaacc gccgtccaat tttaatcatc gttactctgg aaaccagaga tgggcaagtc
 721 ctgggccgac gttgctttga ggcccggatc tgcgcttgcc caggaagaga ccggaaggcc
 781 gatgaagaca gcatcagaaa gcagcaagta tcagacagcg caaagaacgg cgatggtacg
 841 aagcgccctt tccgtcagaa taccacgga atccagatga cttccatcaa gaaacggaga
 901 tccccagatg atgagctgct gtacctacca gtgagaggcc gtgagactta tgaaatgctg
 961 ctcaagatca aggagtcgct cgagctcatg cagtatctcc ctcagcacac gatcgagacg
1021 tacaggcagc agcagcagca gcagcaccaa cacctacttc agaaacagac ctcgatgcag
1081 tctcagtctt catacggtaa cagctcacca cctctgaaca aaatgaacag catgaacaag
1141 ctgccgtctg tgagccagct tatcaaccca cagcagcgca acgccctgac tcccaccacc
1201 atgcctgagg gcatgggagc caacattcct atgatgggca ctcacatgcc aatggctgga
1261 gacatgaatg gactcagccc cacccaagct cttcctcctc cactctccat gccctccacc
1321 tcccactgca cccccccacc tccgtaccca acagactgca gcattgtcag tttcttagca
1381 aggttgggct gttcatcatg tctggactat ttcacgaccc aggggctgac caccatctat
1441 cagattgagc attactccat ggatgatttg gcaagtctga agatccctga gcagttccga
1501 catgccatct ggaaggggat cctggaccac aggcagctgc atgacttctc ctcacctccg
1561 catctcctga gaacccccag tggtgcctct acagtcagtg tgggctccag tgagacccgt
1621 ggagaacgtg tgattgatgc cgtgcgcttt actctccgcc agaccatctc tttcccaccc
1681 cgtgatgagt ggaacgattt caactttgac atggattccc gtcgcaacaa gcagcagcgc
1741 atcaaagagg aaggagaatg aacgtccgtc gccgggttct tcctgtttc ttcctcctcc
1801 cagctcccac agggcacgcc tgcttgatcc tcaaagcctt ctcgctagct ctcctcctcc
1861 tccttctcag tctggtttct aaagggacgg agaattaaga ggctacctgt tacctaaagt
1921 ctgacctgtc acctgattct gatcctggct ttaagccttc aatactcttg cttgcaagat
1981 gcgttgacat tgctagatag acgttagcag agaagcagtg ggtctctcta agcactggag
2041 atcgctcatt gacttttata aagcattttc agccttatag tctaagacta tatatataaa
2101 tatataaata tacaatatat atttcgggtg ggggtattga gtattgttta aatgtaattt
2161 aatggaaatc gagttgcact tatcaacctt ctttggaatt tgcttgtttt ggttggctga
2221 tctgtacccc tttctcaggg gtatcatgta tggtgacaga tatttagagt tgaatggtct
2281 atgtgagtaa cagtgatata taggtcctct cctttctttg gatgattgcc gtttagcaca
2341 tcaaacctgt ggatgcgtcc agtctgttta ccattgctcc ttatgaggta aaactgcata
2401 tactgtcagt ctattttatg ttactggtgt ccattccagt taggctggtt cactctgtgg
2461 ccattccaag caaaatttta tgtttgcttt gtcacacact agaagacagg gcatcatctc
2521 ttgcttttgt ttgagaatga ggagtacttt tttttttttc tggaaaatct taaatggtcc
2581 aaatcagcca ttccaaatgg ctgatgaaat gtagccaata tagcagttag ctctctaaaa
2641 tttaagaccc aacaccctcg tatttattag taaaacaaaa atgaaacatt tgctgtcatt
2701 agagtagcct taaaattaaa tttcaatacc agattgactg agtaaactat gcattcaatg
2761 ttgttgtgag aattggggct aattagtcag gatgattgga atttgtgtag ttttttatgg
2821 tgagttgcaa tatctattta ggaaggttca ggaataataa gaatgactca gaaatactca
2881 atctccgtga caacagaaag caatctcacc aaactctgaa tttaaacccc ttttgaaaca
2941 tggagtgagg cttgggaaat gtacctttta aagactttcc tatctataag acactgcatg
3001 caggggcaag tttaatctct catcaaggtg gaaaataaga atagtagctc ggaaactaca
3061 aacttgctag tgtagctttc acatggcatg agctcaacta ttgttatttt cctctttatc
3121 atcaaagctc cattgctgta gaaagcagag gtgaagaccc agttttccac ctgacacttt
3181 ccgggcaagg catagaccaa gaactgtcta caaaaccagg gcaaagctct tcagtgaagc
3241 tgtttaattc acatggagaa acacttgttt cccactttgg gaaagcatgc aacagtgttc
3301 cccctagatg ttttggaaac attttgagtc aaatatattt ttcccagact aaaccaggct
3361 aatgagctct acaatcctcc tgcacatttt ggtaaagggc tgtcattgca caggagctcc
3421 catttttatc ttaaagtgca aatgggctaa tacgcctacg aaatgtaatg tatgggtttt
3481 gccagaaaat agtatattgt gtacacgtgt ctgtgtgtga gtgtgagagt gtgtgtgtgt
3541 gtgtgtgtgt gtgtgtgtgt gaaattgcat actatgctgg ttttgtttgt tactctttct
3601 cttggggata gttgggtttt ccagaaccac agacgaaact tttttttgtt gctgttttta
3661 tatttttgca gaaacaccat ttagtgagaa ttcaatgtca aattagacat gacaccttaa
3721 ttgtaagaag gggggagagg gaaagttggt ttttttttaat tttttaaaat tttgtatact
3781 aaagagaatg agtccttaat ttcaacattc tgttgcattt aaataatgat aagcatcatt
3841 aacttctgta acaacttccc agcttggcaa attcaatgca tggagaacaa agctgggcct
3901 tagccatgtt agggagaaaa atggcttctt gggggttgtg agcatttggg ttgctttagc
3961 accgttgagg tggcacaggg gactcctgag gcatttcagc actacttacg tagcactagg
4021 gactcggaaa ttcctgtact gtagctaatg attttggcgt tcaccattag cagtagatag
4081 gccgtttctc tcctcacacc agtgttaagc gtgtgagtag ccagagctgt ggggaagagc
4141 atggagaaca gacgtctgct ggatgcctct caccggagaa tgagattcct tcgcgtggtg
4201 gtgaagtagg ataggaagca ggagtctcct tgttagtcca gttagctatt gttttcttga
4261 tattcccccc caaaacattg actatgagag atatgtgggg cttttttatt tttataattg
4321 tacaaaatta aacaaatatg aaatgtttta tatactttat taatgttttt tttcaaaagg
4381 tactttctta tagacatgat cctttttttta caggttcagt tgcttgtccc ttggtatttt
```

TABLE 1-continued

```
4441 tgtgttatgg gctatggtga gcctgaggca aatctataag ccatttttgt ttgccaggac
4501 atgcaataaa atttaaaaat aaatgaaaat acactgaaaa aaaaaaaaaa aaaaaaaaaa
4561 aa

SEQ ID NO: 66 Rat p63 Isoform D Amino Acid Sequence (NP_001120814.1)
   1 mlylesnaqt qfsepqytnl gllngmdqqi qngssstspy ntdhaqnsvt apspyaqpss
  61 tfdalspspa ipsntdypgp hsfdvsfqqs staksatwty stelkklycq iaktcpiqik
 121 vmtpppqgav irampvykka ehvtevvkrc pnhelsrefn egqiappshl irvegnshaq
 181 yvedpitgrq svlvpyeppq vgteftvtvly nfmcnsscvg gmnrrpilii vtletrdgqv
 241 lgrrcfeari cacpgrdrka dedsirkqqv sdsakngdgt krpfrqnthg iqmtsikkrr
 301 spddellylp vrgretyeml lkikeslelm qylpqhtiet yrqqqqqhq hllqkqtsmq
 361 sqssygnssp plnkmnsmnk lpsysqlinp qqrnaltptt mpegmganip mmgthmpmag
 421 dmnglsptqa lppplsmpst shctppppyp tdcsivsfla rlgcsscldy fttqglttiy
 481 qiehysmddl aslkipeqfr haiwkgildh rqlhdfsspp hllrtpsgas tvsvgssetr
 541 gervidavrf tlrqtisfpp rdewndfnfd mdsrrnkqqr ikeege

SEQ ID NO: 67 Rat p63 transcript variant 5 Sequence (NM_001127343.1; CDS: 1-
1386)
   1 atgttgtacc tggaaagcaa tgcccagact caatttagtg agccacagta cacgaacctg
  61 gggctcctga acggcatgga ccagcagatt cagaacggct cctcatctac cagcccctat
 121 aacacagacc atgcacagaa cagcgtgacg gcaccctcgc cctatgcaca gcccagctca
 181 accttcgatg ccctttctcc atcccctgcc attccctcca acacagatta cccaggccca
 241 cacagcttcg atgtgtcctt ccagcagtca agcaccgcca agtcagctac ctggacgtat
 301 tccaccgaac tgaagaaact ctactgccag attgcaaaga cctgccccat ccagatcaag
 361 gtgatgaccc cacccccaca gggcgccgtc attcgtgcca tgcctgtcta caagaaagcc
 421 gagcatgtca ccgaggttgt gaaacgatgt cctaaccacg agctgagccg cgagttcaat
 481 gagggacaga ttgcccctcc cagtcatctg attcgagtag aagggaacag ccatgcccag
 541 tatgtagaag atcctatcac aggaaggcag agcgtgctgg tcccttatga gccaccacag
 601 gttggcactg aattcacaac agtcctgtac aatttcatgt gcaacagcag ctgtgtcgga
 661 ggaatgaacc gccgtccaat tttaatcatc gttactctgg aaaccagaga tgggcaagtc
 721 ctgggccgac gttgctttga ggcccggatc tgcgcttgcc caggaagaga ccggaaggcc
 781 gatgaagaca gcatcagaaa gcagcaagta tcagacagcg caaagaacgg cgatggtacg
 841 aagcgccctt tccgtcagaa tacccacgga atccagatga cttccatcaa gaaacggaga
 901 tccccagatg atgagctgct gtacctacca gtgagaggcc gtgagactta tgaaatgctg
 961 ctcaagatca aggagtcgct cgagctcatg cagtatctcc ctcagcacac gatcgagacg
1021 tacaggcagc agcagcagca gcagcaccaa cacctacttc agaaacagac ctcgatgcag
1081 tctcagtctt catacggtaa cagctcacca cctctgaaca aaatgaacag catgaacaag
1141 ctgccgtctg tgagccagct tatcaaccca cagcagcgca acgccctgac tcccaccacc
1201 atgcctgagg gcatgggagc caacattcct atgatgggca ctcacatgcc aatggctgga
1261 gacatgaatg gactcagccc cacccaagct cttcctcctc cactctccat gccctccacc
1321 tcccactgca cccccccacc tccgtaccca acagactgca gcattgtcag gatttggcaa
1381 gtctgaagat ccctgagcag ttccgacatg ccatctggaa ggggatcctg gaccacaggc
1441 agctgcatga cttctcctca cctccgcatc tcctgagaac cccccagtggt gcctctacag
1501 tcagtgtggg ctccagtgag acccgtggag aacgtgtgat tgatgccgtg cgctttactc
1561 tccgccagac catctctttc ccaccccgtg atgagtggaa cgatttcaac tttgacatgg
1621 attcccgtcg caacaagcag cagcgcatca aagaggaagg agaatgaacg tccgtcgccg
1681 ggttcttcct gttttcttcc tcctcccagc tcccacaggg cacgcctgct tgatcctcaa
1741 agccttctcg ctagctctcc tcctcctcct tctcagtctg gtttctaaag ggacggagaa
1801 ttaagaggct acctgttacc taaagtctga cctgtcacct gattctgatc ctggctttaa
1861 gccttcaata ctcttgcttg caagatgcgt tgacattgct agatagacgt tagcagagaa
1921 gcagtgggtc tctctaagca ctggagatcg ctcattgact tttataaagc attttcagcc
1981 ttatagtcta agactatata tataaatata taaatataca atatatattt cgggtggggg
2041 tattgagtat tgtttaaatg taatttaatg gaaatcgagt tgcacttatc aaccttcttt
2101 ggaatttgct tgttttggtt ggctgatctg taccccctttc tcaggggtat catgtatggt
2161 gacagatatt tagagttgaa tggtctatgt gagtaacagt gatatatagg tcctctcctt
2221 tctttggatg attgccgttt agcacatcaa acctgtggat gcgtccagtc tgtttaccat
2281 tgctccttat gaggtaaaac tgcatatact gtcagtctat tttatgttac tggtgtccat
2341 tccagttagg ctggttcact ctgtggccat tccaagcaaa atttatgtt tgctttgtca
2401 cacactagaa gacagggcat catctcttgc ttttgtttga gaatgaggag tacttttttt
2461 tttttctgga aaatcttaaa tggtccaaat cagccattcc aaatggctga tgaaatgtag
2521 ccaatatagc agttagctct ctaaaattta agacccaaca ccctcgtatt tattagtaaa
2581 acaaaaatga aacatttgct gtcattagag tagccttaaa attaaatttc aataccagat
2641 tgactgagta aactatgcat tcaatgttgt tgtgagaatt ggggctaatt agtcaggatg
2701 attggaattt gtgtagtttt ttatggtgag ttgcaatatc tatttaggaa ggttcaggaa
2761 taataagaat gactcagaaa tactcaatct ccgtgacaac agaaagcaat ctcaccaaac
2821 tctgaattta aacccctttt gaaacatgga gtgaggcttg ggaaatgtac cttttaaaga
2881 ctttcctatc tataagacac tgcatgcagg ggcaagttta atctctcatc aaggtggaaa
2941 ataagaatag tagctcggaa actacaaact tgctagtgta gctttcacat ggcatgagct
3001 caactattgt tattttcctc tttatcatca aagctccatt gctgtagaaa gcagaggtga
3061 agacccagtt ttccacctga cactttccgg gcaaggcata gaccaagaac tgtctacaaa
3121 accagggcaa agctcttcag tgaagctgtt taattcacat ggagaaacac ttgtttccca
3181 ctttgggaaa gcatgcaaca gtgttccccc tagatgtttt ggaaacattt tgagtcaaat
3241 atatttttcc cagactaaac caggctaatg agctctacaa tcctcctgca cattttggta
3301 aagggctgtc attgcacagg agctcccatt tttatcttaa agtgcaaatg ggctaatacg
3361 cctacgaaat gtaatgtatg ggttttgcca gaaaatagta tattgtgtac acgtgtctgt
3421 gtgtgagtgt gagagtgtgt gtgtgtgtgt gtgtgtgtgt gtgtgtgaaa ttgcatacta
3481 tgctggtttt gtttgttact ctttctcttg gggatagttg ggttttccag aaccacagac
3541 gaaacttttt tttgttgctg tttttatatt tttgcagaaa caccatttag tgagaattca
3601 atgtcaaatt agacatgaca ccttaattgt aagaaggggg gagagggaaa gttggttttt
3661 tttaattttt taaaattttg tatactaaag agaatgagtc cttaatttca acattctgtt
```

TABLE 1-continued

```
3721 gcatttaaat aatgataagc atcattaact tctgtaacaa cttcccagct tggcaaattc
3781 aatgcatgga gaacaaagct gggccttagc catgttaggg agaaaaatgg cttcttgggg
3841 gttgtgagca tttgggttgc tttagcaccg ttgaggtggc acaggggact cctgaggcat
3901 ttcagcacta cttacgtagc actagggact cggaaattcc tgtactgtag ctaatgattt
3961 tggcgttcac cattagcagt agataggccg tttctctcct cacaccagtg ttaagcgtgt
4021 gagtagccag agctgtgggg aagagcatgg agaacagacg tctgctggat gcctctcacc
4081 ggagaatgag attccttcgc gtggtggtga agtaggatag gaagcaggag tctccttgtt
4141 agtccagtta gctattgttt tcttgatatt cccccccaaa acattgacta tgagagatat
4201 gtggggcttt tttattttta taattgtaca aaattaaaca aatatgaaat gttttatata
4261 ctttattaat gtttttttc aaaaggtact ttcttataga catgatcctt tttttacagg
4321 ttcagttgct tgtcccttgg tatttttgtg ttatgggcta tggtgagcct gaggcaaatc
4381 tataagccat ttttgtttgc caggacatgc aataaaattt aaaaataaat gaaaatacac
4441 tgaaaaaaaa aaaaaaaaaa aaaaaaaa
```

SEQ ID NO: 68 Rat p63 Isoform 5 Amino Acid Sequence (NP_001120815.1)

```
  1 mlylesnaqt qfsepqytnl gllngmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdsakngdgt krpfrqnthg iqmtsikkrr
301 spddellylp vrgretyeml lkikeslelm qylpqhtiet yrqqqqqhq hllqkqtsmq
361 sqssygnssp plnkmnsmnk lpsysqlinp qqrnaltptt mpegmganip mmgthmpmag
421 dmnglsptqa lppplsmpst shctppppyp tdcsivriwq v
```

SEQ ID NO: 69 Rat p63 transcript variant 6 Sequence (NM_001127344.1; CDS: 1-1182)

```
   1 atgttgtacc tggaaagcaa tgcccagact caatttagtg agccacagta cacgaacctg
  61 gggctcctga acggcatgga ccagcagatt cagaacggct cctcatctac cagcccctat
 121 aacacagacc atgcacagaa cagcgtgacg gcaccctcgc cctatgcaca gcccagctca
 181 accttcgatg ccctttctcc atcccctgcc attccctcca acacagatta cccaggccca
 241 cacagcttcg atgtgtcctt ccagcagtca agcaccgcca agtcagctac ctggacgtat
 301 tccaccgaac tgaagaaact ctactgccag attgcaaaga cctgccccat ccagatcaag
 361 gtgatgaccc cacccccaca gggcgccgtc attcgtgcca tgcctgtcta caagaaagcc
 421 gagcatgtca ccgaggttgt gaaacgatgt cctaaccacg agctgagccg cgagttcaat
 481 gagggacaga ttgcccctcc cagtcatctg attcgagtag aagggaacag ccatgcccag
 541 tatgtagaag atcctatcac aggaaggcag agcgtgctgg tcccttatga gccaccacag
 601 gttggcactg aattcacaac agtcctgtac aatttcatgt gcaacagcag ctgtgtcgga
 661 ggaatgaacc gccgtccaat tttaatcatc gttactctgg aaaccagaga tgggcaagtc
 721 ctgggccgac gttgctttga ggcccggatc tgcgcttgcc caggaagaga ccggaaggcc
 781 gatgaagaca gcatcagaaa gcagcaagta tcagacagcg caaagaacgg cgatggtacg
 841 aagcgccctt tccgtcagaa tacccacgga atccagatga cttccatcaa gaaacggaga
 901 tccccagatg atgagctgct gtacctacca gtgagaggcc gtgagactta tgaaatgctg
 961 ctcaagatca aggagtcgct cgagctcatg cagtatctcc ctcagcacac gatcgagacg
1021 tacaggcagc agcagcagca gcagcaccaa cacctacttc agaaacatct cctttcagcc
1081 tgcttcagga atgagcttgt ggagtcccgg agagaagctc cgacacagtc tgacgtcttc
1141 tttagacatt ccaaccccc aaaccactca gtgtacccat ag
```

SEQ ID NO: 70 Rat p63 Isoform 6 Amino Acid Sequence (NP_001120816.1)

```
  1 mlylesnaqt qfsepqytnl gllngmdqqi qngssstspy ntdhaqnsvt apspyaqpss
 61 tfdalspspa ipsntdypgp hsfdvsfqqs staksatwty stelkklycq iaktcpiqik
121 vmtpppqgav irampvykka ehvtevvkrc pnhelsrefn egqiappshl irvegnshaq
181 yvedpitgrq svlvpyeppq vgtefttvly nfmcnsscvg gmnrrpilii vtletrdgqv
241 lgrrcfeari cacpgrdrka dedsirkqqv sdsakngdgt krpfrqnthg iqmtsikkrr
301 spddellylp vrgretyeml lkikeslelm qylpqhtiet yrqqqqqhq hllqkhilsa
361 cfrnelvesr reaptqsdvf frhsnppnhs vyp
```

SEQ ID NO: 71 Human TP53 Isoform a Amino Acid Sequence (NP_000537.3; NP_001119584.1)

```
  1 meepqsdpsv epplsqetfs dlwkllpenn vlsplpsqam ddlmlspddi eqwftedpgp
 61 deaprmpeaa ppvapapaap tpaapapaps wplsssvpsq ktyqgsygfr lgflhsgtak
121 svtctyspal nkmfcqlakt cpvqlwvdst pppgtrvram aiykqsqhmt evvrrcphhe
181 rcsdsdglap pqhlirvegn lrveylddrn tfrhsvvvpy eppevgsdct tihynymcns
241 scmggmnrrp iltiitleds sgnllgrnsf evrvcacpgr drrteeenlr kkgephhelp
301 pgstkralpn ntssspqpkk kpldgeyftl qirgrerfem frelnealel kdaqagkepg
361 gsrahsshlk skkgqstsrh kklmfktegp dsd
```

SEQ ID NO: 72 Human TP53 transcript variant 1 cDNA sequence (NM_000546.5; CDS: 203-1384)

```
  1 gatgggattg gggttttccc ctcccatgtg ctcaagactg gcgctaaaag ttttgagctt
 61 ctcaaaagtc tagagccacc gtccagggag caggtagctg ctgggctccg gggacacttt
121 gcgttcgggc tgggagcgtg ctttccacga cggtgacacg cttccctgga ttggcagcca
181 gactgccttc cgggtcactg ccatggagga gccgcagtca gatcctagcg tcgagccccc
241 tctgagtcag gaaacatttt cagacctatg gaaactactt cctgaaaaca acgttctgtc
301 ccccttgccg tcccaagcaa tggatgattt gatgctgtcc ccggacgata ttgaacaatg
361 gttcactgaa gacccaggtc cagatgaagc tcccagaatg ccagaggctg ctccccccgt
421 ggcccctgca ccagcagctc ctacaccggc ggcccctgca ccagccccct cctggcccct
481 gtcatcttct gtcccttccc agaaaaccta ccagggcagc tacggtttcc gtctgggctt
541 cttgcattct gggacagcca agtctgtgac ttgcacgtac tcccctgccc tcaacaagat
601 gttttgccaa ctggccaaga cctgccctgt gcagctgtgg gttgattcca caccccgcc
661 cggcacccgc gtccgcgcca tggccatcta caagcagtca cagcacatga cggaggttgt
```

TABLE 1-continued

```
 721 gaggcgctgc ccccaccatg agcgctgctc agatagcgat ggtctggccc ctcctcagca
 781 tcttatccga gtggaaggaa atttgcgtgt ggagtatttg gatgacagaa acacttttcg
 841 acatagtgtg gtggtgccct atgagccgcc tgaggttggc tctgactgta ccaccatcca
 901 ctacaactac atgtgtaaca gttcctgcat gggcggcatg aaccggaggc ccatcctcac
 961 catcatcaca ctggaagact ccagtggtaa tctactggga cggaacagct ttgaggtgcg
1021 tgtttgtgcc tgtcctggga gagaccggcg cacagaggaa gagaatctcc gcaagaaagg
1081 ggagcctcac cacgagctgc ccccagggag cactaagcga gcactgccca acaacaccag
1141 ctcctctccc cagccaaaga agaaaccact ggatggagaa tatttcaccc ttcagatccg
1201 tgggcgtgag cgcttcgaga tgttccgaga gctgaatgag gccttggaac tcaaggatgc
1261 ccaggctggg aaggagccag gggggagcag ggctcactcc agccacctga agtccaaaaa
1321 gggtcagtct acctcccgcc ataaaaaact catgttcaag acagaagggc ctgactcaga
1381 ctgacattct ccacttcttg ttccccactg acagcctccc acccccatct ctccctcccc
1441 tgccattttg ggttttgggt ctttgaaccc ttgcttgcaa taggtgtgcg tcagaagcac
1501 ccaggacttc catttgcttt gtcccggggc tccactgaac aagttggcct gcactggtgt
1561 tttgttgtgg ggaggaggat ggggagtagg acataccagc ttagatttta aggtttttac
1621 tgtgagggat gtttgggaga tgtaagaaat gttcttgcag ttaagggtta gtttacaatc
1681 agccacattc taggtagggg cccacttcac cgtactaacc agggaagctg tccctcactg
1741 ttgaattttc tctaacttca aggcccatat ctgtgaaatg ctggcatttg cacctacctc
1801 acagagtgca ttgtgagggt taatgaaata atgtacatct ggccttgaaa ccacctttta
1861 ttacatgggg tctagaactt gacccccttg agggtgcttg ttccctctcc ctgttggtcg
1921 gtgggttggt agtttctaca gttgggcagc tggttaggta gagggagttg tcaagtctct
1981 gctggcccag ccaaaccctg tctgacaacc tcttggtgaa ccttagtacc taaaaggaaa
2041 tctcacccca tcccacaccc tggaggattt catctcttgt atatgatgat ctggatccac
2101 caagacttgt tttatgctca gggtcaattt ctttttttctt ttttttttt ttttttcttt
2161 ttctttgaga ctgggtctcg ctttgttgcc caggctggag tggagtggcg tgatcttggc
2221 ttactgcagc ctttgcctcc ccggctcgag cagtcctgcc tcagcctccg gagtagctgg
2281 gaccacaggt tcatgccacc atggccagcc aacttttgca tgttttgtag agatggggtc
2341 tcacagtgtt gcccaggctg gtctcaaact cctgggctca ggcgatccac ctgtctcagc
2401 ctcccagagt gctgggatta caattgtgag ccaccacgtc cagctggaag ggtcaacatc
2461 ttttacattc tgcaagcaca tctgcatttt caccccaccc ttcccctcct tctccctttt
2521 tatatcccat ttttatatcg atctcttatt ttacaataaa actttgctgc cacctgtgtg
2581 tctgaggggt g
```

SEQ ID NO: 73 Human TP53 transcript variant 2 cDNA sequence
(NM_001126112.2; CDS: 200-1381)

```
   1 gatgggattg ggttttcccc ctcccatgtg ctcaagactg gcgctaaaag ttttgagctt
  61 ctcaaaagtc tagagccacc gtccagggag caggtagctg ctgggctccg gggacacttt
 121 gcgttcgggc tgggagcgtg ctttccacga cggtgacacg cttccctgga ttggccagac
 181 tgccttccgg gtcactgcca tggaggagcc gcagtcagat cctagcgtcg agccccctct
 241 gagtcaggaa acattttcag acctatggaa actacttcct gaaaacaacg ttctgtcccc
 301 cttgccgtcc caagcaatgg atgatttgat gctgtccccg gacgatattg aacaatggtt
 361 cactgaagac ccaggtccag atgaagctcc cagaatgcca gaggctgctc cccccgtggc
 421 ccctgcacca gcagctccta caccggcggc ccctgcacca gccccctcct ggcccctgtc
 481 atcttctgtc ccttcccaga aaacctacca gggcagctac ggtttccgtc tgggcttctt
 541 gcattctggg acagccaagt ctgtgacttg cacgtactcc cctgccctca acaagatgtt
 601 ttgccaactg gccaagacct gccctgtgca gctgtgggtt gattccacac ccccgcccgg
 661 cacccgcgtc cgcgccatgg ccatctacaa gcagtcacag cacatgacgg aggttgtgag
 721 gcgctgcccc caccatgagc gctgctcaga tagcgatggt ctggcccctc ctcagcatct
 781 tatccgagtg gaaggaaatt tgcgtgtgga gtatttggat gacagaaaca cttttcgaca
 841 tagtgtggtg gtgccctatg agccgcctga ggttggctct gactgtacca ccatccacta
 901 caactacatg tgtaacagtt cctgcatggg cggcatgaac cggaggccca tcctcaccat
 961 catcacactg gaagactcca gtggtaatct actgggacgg aacagctttg aggtgcgtgt
1021 ttgtgcctgt cctgggagag accggcgcac agaggaagag aatctccgca agaaagggga
1081 gcctcaccac gagctgcccc cagggagcac taagcgagca ctgcccaaca acaccagctc
1141 ctctccccag ccaaagaaga aaccactgga tggagaatat ttcacccttc agatccgtgg
1201 gcgtgagcgc ttcgagatgt tccgagagct gaatgaggcc ttggaactca aggatgccca
1261 ggctgggaag gagccagggg ggagcagggc tcactccagc cacctgaagt ccaaaaaggg
1321 tcagtctacc tcccgccata aaaaactcat gttcaagaca gaagggcctg actcagactg
1381 acattctcca cttcttgttc cccactgaca gcctcccacc cccatctctc cctcccctgc
1441 cattttgggt tttgggtctt tgaacccttg cttgcaatag gtgtgcgtca gaagcaccca
1501 ggacttccat ttgctttgtc ccggggctcc actgaacaag ttggcctgca ctggtgtttt
1561 gttgtgggga ggaggatggg gagtaggaca taccagctta gattttaagg tttttactgt
1621 gagggatgtt tgggagatgt aagaaatgtt cttgcagtta agggttagtt tacaatcagc
1681 cacattctag gtaggggccc acttcaccgt actaaccagg gaagctgtcc ctcactgttg
1741 aattttctct aacttcaagg cccatatctg tgaaatgctg gcatttgcac ctacctcaca
1801 gagtgcattg tgagggttaa tgaaataatg tacatctggc cttgaaacca ccttttatta
1861 catggggtct agaacttgac cccccttgagg gtgcttgttc cctctccctg ttggtcggtg
1921 ggttggtagt ttctacagtt gggcagctgg ttaggtagag ggagttgtca agtctctgct
1981 ggcccagcca aaccctgtct gacaacctct tggtgaacct tagtacctaa aaggaaatct
2041 caccccatcc cacaccctgg aggatttcat ctcttgtata tgatgatctg gatccaccaa
2101 gacttgtttt atgctcaggg tcaatttctt ttttcttttt ttttttttt tttctttttc
2161 tttgagactg ggtctcgctt tgttgcccag gctggagtgg agtggcgtga tcttggctta
2221 ctgcagcctt tgcctccccg gctcgagcag tcctgcctca gcctccggag tagctgggac
2281 cacaggttca tgccaccatg gccagccaac ttttgcatgt tttgtagaga tggggtctca
2341 cagtgttgcc caggctggtc tcaaactcct gggctcaggc gatccacctg tctcagcctc
2401 ccagagtgct gggattacaa ttgtgagcca ccacgtccag ctggaagggt caacatcttt
2461 tacattctgc aagcacatct gcattttcac cccacccttc ccctccttct cccttttat
2521 atcccatttt tatatcgatc tcttatttta caataaaact ttgctgccac ctgtgtgtct
2581 gaggggtg
```

TABLE 1-continued

SEQ ID NO: 74 Human TP53 isoform b Amino Acid Sequence (NP_001119586.1)
1 meepqsdpsv epplsqetfs dlwkllpenn vlsplpsqam ddlmlspddi eqwftedpgp
61 deaprmpeaa ppvapapaap tpaapapaps wplsssvpsq ktyqgsygfr lgflhsgtak
121 svtctyspal nkmfcqlakt cpvqlwvdst pppgtrvram aiykqsqhmt evvrrcphhe
181 rcsdsdglap pqhlirvegn lrveylddrn tfrhsvvvpy eppevgsdct tihynymcns
241 scmggmnrrp iltiitleds sgnllgrnsf evrvcacpgr drrteeenlr kkgephhelp
301 pgstkralpn ntssspqpkk kpldgeyftl qdqtsfqken c SEQ ID NO: 75 Human TP53 transcript variant 3 cDNA sequence
(NM_001126114.2; CDS: 203-1228)
1 gatgggattg gggttttccc ctcccatgtg ctcaagactg gcgctaaaag ttttgagctt
61 ctcaaaagtc tagagccacc gtccagggag caggtagctg ctgggctccg gggacacttt
121 gcgttcgggc tgggagcgtg ctttccacga cggtgacacg cttccctgga ttggcagcca
181 gactgccttc cgggtcactg ccatggagga gccgcagtca gatcctagcg tcgagccccc
241 tctgagtcag gaaacatttt cagacctatg gaaactactt cctgaaaaca acgttctgtc
301 ccccttgccg tcccaagcaa tggatgattt gatgctgtcc ccggacgata ttgaacaatg
361 gttcactgaa gacccaggtc cagatgaagc tcccagaatg ccagaggctg ctccccccgt
421 ggcccctgca ccagcagctc ctacaccggc ggcccctgca ccagccccct cctggcccct
481 gtcatcttct gtcccttccc agaaaaccta ccagggcagc tacggtttcc gtctgggctt
541 cttgcattct gggacagcca agtctgtgac ttgcacgtac tcccctgccc tcaacaagat
601 gttttgccaa ctggccaaga cctgccctgt gcagctgtgg gttgattcca cacccccgcc
661 cggcacccgc gtccgcgcca tggccatcta caagcagtca cagcacatga cggaggttgt
721 gaggcgctgc ccccaccatg agcgctgctc agatagcgat ggtctggccc ctcctcagca
781 tcttatccga gtggaaggaa atttgcgtgt ggagtatttg gatgacagaa acacttttcg
841 acatagtgtg gtggtgccct atgagccgcc tgaggttggc tctgactgta ccaccatcca
901 ctacaactac atgtgtaaca gttcctgcat gggcggcatg aaccggaggc ccatcctcac
961 catcatcaca ctggaagact ccagtggtaa tctactggga cggaacagct ttgaggtgcg
1021 tgtttgtgcc tgtcctggga gagaccggcg cacagaggaa gagaatctcc gcaagaaagg
1081 ggagcctcac cacgagctgc ccccagggag cactaagcga gcactgccca acaacaccag
1141 ctcctctccc cagccaaaga agaaaccact ggatggagaa tatttcaccc ttcaggacca
1201 gaccagcttt caaaaagaaa attgttaaag agagcatgaa aatggttcta tgactttgcc
1261 tgatacagat gctacttgac ttacgatggt gttacttcct gataaactcg tcgtaagttg
1321 aaaatattat ccgtgggcgt gagcgcttcg agatgttccg agagctgaat gaggccttgg
1381 aactcaagga tgcccaggct gggaaggagc caggggggag cagggctcac tccagccacc
1441 tgaagtccaa aaagggtcag tctacctccc gccataaaaa actcatgttc aagacagaag
1501 ggcctgactc agactgacat tctccacttc ttgttcccca ctgacagcct cccaccccca
1561 tctctccctc ccctgccatt ttgggttttg ggtctttgaa cccttgcttg caataggtgt
1621 gcgtcagaag cacccaggac ttccatttgc tttgtcccgg ggctccactg aacaagttgg
1681 cctgcactgg tgttttgttg tggggaggag gatggggagt aggacatacc agcttagatt
1741 ttaaggtttt tactgtgagg gatgtttggg agatgtaaga aatgttcttg cagttaaggg
1801 ttagtttaca atcagccaca ttctaggtag gggcccactt caccgtacta accagggaag
1861 ctgtccctca ctgttgaatt ttctctaact tcaaggccca tatctgtgaa atgctggcat
1921 ttgcacctac ctcacagagt gcattgtgag ggttaatgaa ataatgtaca tctggccttg
1981 aaaccacctt ttattacatg gggtctagaa cttgaccccc ttgagggtgc ttgttccctc
2041 tccctgttgg tcggtgggtt ggtagtttct acagttgggc agctggttag gtagagggag
2101 ttgtcaagtc tctgctggcc cagccaaacc ctgtctgaca acctcttggt gaaccttagt
2161 acctaaaagg aaatctcacc ccatccccaca ccctggagga tttcatctct tgtatatgat
2221 gatctggatc caccaagact tgttttatgc tcagggtcaa tttctttttt cttttttttt
2281 tttttttttc tttttctttg agactgggtc tcgctttgtt gcccaggctg gagtggagtg
2341 gcgtgatctt ggcttactgc agcctttgcc tccccggctc gagcagtcct gcctcagcct
2401 ccggagtagc tgggaccaca ggttcatgcc accatggcca gccaactttt gcatgttttg
2461 tagagatggg gtctcacagt gttgcccagg ctggtctcaa actcctgggc tcaggcgatc
2521 cacctgtctc agcctcccag agtgctggga ttacaattgt gagccaccac gtccagctgg
2581 aagggtcaac atcttttaca ttctgcaagc acatctgcat tttcacccca cccttcccct
2641 ccttctccct ttttatatcc catttttata tcgatctctt attttacaat aaaactttgc
2701 tgccacctgt gtgtctgagg ggtg SEQ ID NO: 76 Human TP53 isoform c Amino Acid Sequence (NP_001119585.1)
1 meepqsdpsv epplsqetfs dlwkllpenn vlsplpsqam ddlmlspddi eqwftedpgp
61 deaprmpeaa ppvapapaap tpaapapaps wplsssvpsq ktyqgsygfr lgflhsgtak
121 svtctyspal nkmfcqlakt cpvqlwvdst pppgtrvram aiykqsqhmt evvrrcphhe
181 rcsdsdglap pqhlirvegn lrveylddrn tfrhsvvvpy eppevgsdct tihynymcns
241 scmggmnrrp iltiitleds sgnllgrnsf evrvcacpgr drrteeenlr kkgephhelp
301 pgstkralpn ntssspqpkk kpldgeyftl qmlldlrwcy flinss SEQ ID NO: 77 Human TP53 transcript variant 4 cDNA sequence
(NM_001126113.2; CDS: 203-1243)
1 gatgggattg gggttttccc ctcccatgtg ctcaagactg gcgctaaaag ttttgagctt
61 ctcaaaagtc tagagccacc gtccagggag caggtagctg ctgggctccg gggacacttt
121 gcgttcgggc tgggagcgtg ctttccacga cggtgacacg cttccctgga ttggcagcca
181 gactgccttc cgggtcactg ccatggagga gccgcagtca gatcctagcg tcgagccccc
241 tctgagtcag gaaacatttt cagacctatg gaaactactt cctgaaaaca acgttctgtc
301 ccccttgccg tcccaagcaa tggatgattt gatgctgtcc ccggacgata ttgaacaatg
361 gttcactgaa gacccaggtc cagatgaagc tcccagaatg ccagaggctg ctccccccgt
421 ggcccctgca ccagcagctc ctacaccggc ggcccctgca ccagccccct cctggcccct
481 gtcatcttct gtcccttccc agaaaaccta ccagggcagc tacggtttcc gtctgggctt
541 cttgcattct gggacagcca agtctgtgac ttgcacgtac tcccctgccc tcaacaagat
601 gttttgccaa ctggccaaga cctgccctgt gcagctgtgg gttgattcca cacccccgcc
661 cggcacccgc gtccgcgcca tggccatcta caagcagtca cagcacatga cggaggttgt
721 gaggcgctgc ccccaccatg agcgctgctc agatagcgat ggtctggccc ctcctcagca TABLE 1-continued

```
 781 tcttatccga gtggaaggaa atttgcgtgt ggagtatttg gatgacagaa acacttttcg
 841 acatagtgtg gtggtgccct atgagccgcc tgaggttggc tctgactgta ccaccatcca
 901 ctacaactac atgtgtaaca gttcctgcat gggcggcatg aaccggaggc ccatcctcac
 961 catcatcaca ctggaagact ccagtggtaa tctactggga cggaacagct ttgaggtgcg
1021 tgtttgtgcc tgtcctggga gagaccggcg cacagaggaa gagaatctcc gcaagaaagg
1081 ggagcctcac cacgagctgc ccccagggag cactaagcga gcactgccca acaacaccag
1141 ctcctctccc cagccaaaga agaaaccact ggatggagaa tatttcaccc ttcagatgct
1201 acttgactta cgatggtgtt acttcctgat aaactcgtcg taagttgaaa atattatccg
1261 tgggcgtgag cgcttcgaga tgttccgaga gctgaatgag gccttggaac tcaaggatgc
1321 ccaggctggg aaggagccag gggggagcag ggctcactcc agccacctga agtccaaaaa
1381 gggtcagtct acctcccgcc ataaaaaact catgttcaag acagaagggc ctgactcaga
1441 ctgacattct ccacttcttg ttccccactg acagcctccc acccccatct ctccctcccc
1501 tgccattttg ggttttgggt ctttgaaccc ttgcttgcaa taggtgtgcg tcagaagcac
1561 ccaggacttc catttgcttt gtcccggggc tccactgaac aagttggcct gcactggtgt
1621 tttgttgtgg ggaggaggat ggggagtagg acataccagc ttagatttta aggtttttac
1681 tgtgagggat gtttgggaga tgtaagaaat gttcttgcag ttaagggtta gtttacaatc
1741 agccacattc taggtagggg cccacttcac cgtactaacc agggaagctg tccctcactg
1801 ttgaattttc tctaacttca aggcccatat ctgtgaaatg ctggcatttg cacctacctc
1861 acagagtgca ttgtgagggt taatgaaata atgtacatct ggccttgaaa ccacctttta
1921 ttacatgggg tctagaactt gacccccttg agggtgcttg ttccctctcc ctgttggtcg
1981 gtgggttggt agtttctaca gttgggcagc tggttaggta gagggagttg tcaagtctct
2041 gctggcccag ccaaaccctg tctgacaacc tcttggtgaa ccttagtacc taaaaggaaa
2101 tctcacccca tcccacaccc tggaggattt catctcttgt atatgatgat ctggatccac
2161 caagacttgt tttatgctca gggtcaattt ctttttttctt tttttttttt ttttttcttt
2221 ttctttgaga ctgggtctcg ctttgttgcc caggctggag tggagtggcg tgatcttggc
2281 ttactgcagc ctttgcctcc ccggctcgag cagtcctgcc tcagcctccg gagtagctgg
2341 gaccacaggt tcatgccacc atggccagcc aacttttgca tgttttgtag agatggggtc
2401 tcacagtgtt gcccaggctg gtctcaaact cctgggctca ggcgatccac ctgtctcagc
2461 ctcccagagt gctgggatta caattgtgag ccaccacgtc cagctggaag ggtcaacatc
2521 ttttacattc tgcaagcaca tctgcatttt caccccaccc ttcccctcct tctccctttt
2581 tatatcccat ttttatatcg atctcttatt ttacaataaa actttgctgc cacctgtgtg
2641 tctgaggggt g
```

SEQ ID NO: 78 Human TP53 isoform d Amino Acid Sequence (NP_001119587.1)

```
  1 mfcqlaktcp vqlwvdstpp pgtrvramai ykqsqhmtev vrrcphherc sdsdglappq
 61 hlirvegnlr veylddrntf rhsvvvpyep pevgsdctti hynymcnssc mggmnrrpil
121 tiitledssg nllgrnsfev rvcacpgrdr rteeenlrkk gephhelppg stkralpnnt
181 ssspqpkkkp ldgeyftlqi rgrerfemfr elnealelkd aqagkepggs rahsshlksk
241 kgqstsrhkk lmfktegpds d
```

SEQ ID NO: 79 Human TP53 transcript variant 5 cDNA sequence (NM_001126115.1 CDS: 279-1064)

```
   1 tgaggccagg agatggaggc tgcagtgagc tgtgatcaca ccactgtgct ccagcctgag
  61 tgacagagca agaccctatc tcaaaaaaaa aaaaaaaaaa gaaaagctcc tgaggtgtag
 121 acgccaactc tctctagctc gctagtgggt tgcaggaggt gcttacgcat gtttgtttct
 181 ttgctgccgt cttccagttg ctttatctgt tcacttgtgc cctgactttc aactctgtct
 241 ccttcctctt cctacagtac tcccctgccc tcaacaagat gttttgccaa ctggccaaga
 301 cctgccctgt gcagctgtgg gttgattcca caccccgcc cggcacccgc gtccgcgcca
 361 tggccatcta caagcagtca cagcacatga cggaggttgt gaggcgctgc ccccaccatg
 421 agcgctgctc agatagcgat ggtctggccc ctcctcagca tcttatccga gtggaaggaa
 481 atttgcgtgt ggagtatttg gatgacagaa acacttttcg acatagtgtg gtggtgccct
 541 atgagccgcc tgaggttggc tctgactgta ccaccatcca ctacaactac atgtgtaaca
 601 gttcctgcat gggcggcatg aaccggaggc ccatcctcac catcatcaca ctggaagact
 661 ccagtggtaa tctactggga cggaacagct ttgaggtgcg tgtttgtgcc tgtcctggga
 721 gagaccggcg cacagaggaa gagaatctcc gcaagaaagg ggagcctcac cacgagctgc
 781 ccccagggag cactaagcga gcactgccca acaacaccag ctcctctccc cagccaaaga
 841 agaaaccact ggatggagaa tatttcaccc ttcagatccg tgggcgtgag cgcttcgaga
 901 tgttccgaga gctgaatgag gccttggaac tcaaggatgc ccaggctggg aaggagccag
 961 gggggagcag ggctcactcc agccacctga agtccaaaaa gggtcagtct acctcccgcc
1021 ataaaaaact catgttcaag acagaagggc ctgactcaga ctgacattct ccacttcttg
1081 ttccccactg acagcctccc acccccatct ctccctcccc tgccattttg ggttttgggt
1141 ctttgaaccc ttgcttgcaa taggtgtgcg tcagaagcac ccaggacttc catttgcttt
1201 gtcccggggc tccactgaac aagttggcct gcactggtgt tttgttgtgg ggaggaggat
1261 ggggagtagg acataccagc ttagatttta aggtttttac tgtgagggat gtttgggaga
1321 tgtaagaaat gttcttgcag ttaagggtta gtttacaatc agccacattc taggtagggg
1381 cccacttcac cgtactaacc agggaagctg tccctcactg ttgaattttc tctaacttca
1441 aggcccatat ctgtgaaatg ctggcatttg cacctacctc acagagtgca ttgtgagggt
1501 taatgaaata atgtacatct ggccttgaaa ccacctttta ttacatgggg tctagaactt
1561 gacccccttg agggtgcttg ttccctctcc ctgttggtcg gtgggttggt agtttctaca
1621 gttgggcagc tggttaggta gagggagttg tcaagtctct gctggcccag ccaaaccctg
1681 tctgacaacc tcttggtgaa ccttagtacc taaaaggaaa tctcacccca tcccacaccc
1741 tggaggattt catctcttgt atatgatgat ctggatccac caagacttgt tttatgctca
1801 gggtcaattt ctttttttctt tttttttttt ttttttcttt ttctttgaga ctgggtctcg
1861 ctttgttgcc caggctggag tggagtggcg tgatcttggc ttactgcagc ctttgcctcc
1921 ccggctcgag cagtcctgcc tcagcctccg gagtagctgg gaccacaggt tcatgccacc
1981 atggccagcc aacttttgca tgttttgtag agatggggtc tcacagtgtt gcccaggctg
2041 gtctcaaact cctgggctca ggcgatccac ctgtctcagc ctcccagagt gctgggatta
2101 caattgtgag ccaccacgtc cagctggaag ggtcaacatc ttttacattc tgcaagcaca
2161 tctgcatttt caccccaccc ttcccctcct tctccctttt tatatcccat ttttatatcg
2221 atctcttatt ttacaataaa actttgctgc cacctgtgtg tctgaggggt g
```

TABLE 1-continued

SEQ ID NO: 80 Human TP53 isoform e Amino Acid Sequence (NP_001119588.1)
1 mfcqlaktcp vqlwvdstpp pgtrvramai ykqsqhmtev vrrcphherc sdsdglappq
61 hlirvegnlr veylddrntf rhsvvvpyep pevgsdctti hynymcnssc mggmnrrpil
121 tiitledssg nllgrnsfev rvcacpgrdr rteeenlrkk gephhelppg stkralpnnt
181 ssspqpkkkp ldgeyftlqd qtsfqkenc SEQ ID NO: 81 Human TP53 transcript variant 6 cDNA sequence
(NM_001126116.1; CDS: 279-908)
1 tgaggccagg agatggaggc tgcagtgagc tgtgatcaca ccactgtgct ccagcctgag
61 tgacagagca agaccctatc tcaaaaaaaa aaaaaaaaaa gaaaagctcc tgaggtgtag
121 acgccaactc tctctagctc gctagtgggt tgcaggaggt gcttacgcat gtttgtttct
181 ttgctgccgt cttccagttg ctttatctgt tcacttgtgc cctgactttc aactctgtct
241 ccttcctctt cctacagtac tcccctgccc tcaacaagat gttttgccaa ctggccaaga
301 cctgccctgt gcagctgtgg gttgattcca cacccccgcc cggcacccgc gtccgcgcca
361 tggccatcta caagcagtca cagcacatga cggaggttgt gaggcgctgc ccccaccatg
421 agcgctgctc agatagcgat ggtctggccc ctcctcagca tcttatccga gtggaaggaa
481 atttgcgtgt ggagtatttg gatgacagaa acacttttcg acatagtgtg gtggtgccct
541 atgagccgcc tgaggttggc tctgactgta ccaccatcca ctacaactac atgtgtaaca
601 gttcctgcat gggcggcatg aaccggaggc ccatcctcac catcatcaca ctggaagact
661 ccagtggtaa tctactggga cggaacagct ttgaggtgcg tgtttgtgcc tgtcctggga
721 gagaccggcg cacagaggaa gagaatctcc gcaagaaagg ggagcctcac cacgagctgc
781 ccccagggag cactaagcga gcactgccca acaacaccag ctcctctccc cagccaaaga
841 agaaaccact ggatggagaa tatttcaccc ttcaggacca gaccagcttt caaaaagaaa
901 attgttaaag agagcatgaa aatggttcta tgactttgcc tgatacagat gctacttgac
961 ttacgatggt gttacttcct gataaactcg tcgtaagttg aaaatattat ccgtgggcgt
1021 gagcgcttcg agatgttccg agagctgaat gaggccttgg aactcaagga tgcccaggct
1081 gggaaggagc caggggggag cagggctcac tccagccacc tgaagtccaa aaagggtcag
1141 tctacctccc gccataaaaa actcatgttc aagacagaag ggcctgactc agactgacat
1201 tctccacttc ttgttcccca ctgacagcct cccaccccca tctctccctc ccctgccatt
1261 ttgggttttg ggtctttgaa cccttgcttg caataggtgt gcgtcagaag cacccaggac
1321 ttccatttgc tttgtcccgg ggctccactg aacaagttgg cctgcactgg tgttttgttg
1381 tggggaggag gatggggagt aggacatacc agcttagatt ttaaggtttt tactgtgagg
1441 gatgtttggg agatgtaaga aatgttcttg cagttaaggg ttagtttaca atcagccaca
1501 ttctaggtag ggcccactt caccgtacta accagggaag ctgtccctca ctgttgaatt
1561 ttctctaact tcaaggccca tatctgtgaa atgctggcat ttgcacctac ctcacagagt
1621 gcattgtgag ggttaatgaa ataatgtaca tctggccttg aaaccacctt ttattacatg
1681 gggtctagaa cttgaccccc ttgagggtgc ttgttccctc tccctgttgg tcggtgggtt
1741 ggtagtttct acagttgggc agctggttag gtagagggag ttgtcaagtc tctgctggcc
1801 cagccaaacc ctgtctgaca acctcttggt gaaccttagt acctaaaagg aaatctcacc
1861 ccatccccaca ccctggagga tttcatctct tgtatatgat gatctggatc caccaagact
1921 tgttttatgc tcagggtcaa tttctttttt cttttttttt tttttttttc tttttctttg
1981 agactgggtc tcgctttgtt gcccaggctg gagtggagtg gcgtgatctt ggcttactgc
2041 agcctttgcc tccccggctc gagcagtcct gcctcagcct ccggagtagc tgggaccaca
2101 ggttcatgcc accatggcca gccaactttt gcatgttttg tagagatggg gtctcacagt
2161 gttgcccagg ctggtctcaa actcctgggc tcaggcgatc cacctgtctc agcctcccag
2221 agtgctggga ttacaattgt gagccaccac gtccagctgg aagggtcaac atcttttaca
2281 ttctgcaagc acatctgcat tttcacccca cccttcccct ccttctccct ttttatatcc
2341 catttttata tcgatctctt attttacaat aaaactttgc tgccacctgt gtgtctgagg
2401 ggtg SEQ ID NO: 82 Human TP53 isoform f Amino Acid Sequence (NP_001119589.1)
1 mfcqlaktcp vqlwvdstpp pgtrvramai ykqsqhmtev vrrcphherc sdsdglappq
61 hlirvegnlr veylddrntf rhsvvvpyep pevgsdctti hynymcnssc mggmnrrpil
121 tiitledssg nllgrnsfev rvcacpgrdr rteeenlrkk gephhelppg stkralpnnt
181 ssspqpkkkp ldgeyftlqm lldlrwcyfl inss SEQ ID NO: 83 Human TP53 transcript variant 7 cDNA sequence
(NM_001126117.1; CDS: 279-923)
1 tgaggccagg agatggaggc tgcagtgagc tgtgatcaca ccactgtgct ccagcctgag
61 tgacagagca agaccctatc tcaaaaaaaa aaaaaaaaaa gaaaagctcc tgaggtgtag
121 acgccaactc tctctagctc gctagtgggt tgcaggaggt gcttacgcat gtttgtttct
181 ttgctgccgt cttccagttg ctttatctgt tcacttgtgc cctgactttc aactctgtct
241 ccttcctctt cctacagtac tcccctgccc tcaacaagat gttttgccaa ctggccaaga
301 cctgccctgt gcagctgtgg gttgattcca cacccccgcc cggcacccgc gtccgcgcca
361 tggccatcta caagcagtca cagcacatga cggaggttgt gaggcgctgc ccccaccatg
421 agcgctgctc agatagcgat ggtctggccc ctcctcagca tcttatccga gtggaaggaa
481 atttgcgtgt ggagtatttg gatgacagaa acacttttcg acatagtgtg gtggtgccct
541 atgagccgcc tgaggttggc tctgactgta ccaccatcca ctacaactac atgtgtaaca
601 gttcctgcat gggcggcatg aaccggaggc ccatcctcac catcatcaca ctggaagact
661 ccagtggtaa tctactggga cggaacagct ttgaggtgcg tgtttgtgcc tgtcctggga
721 gagaccggcg cacagaggaa gagaatctcc gcaagaaagg ggagcctcac cacgagctgc
781 ccccagggag cactaagcga gcactgccca acaacaccag ctcctctccc cagccaaaga
841 agaaaccact ggatggagaa tatttcaccc ttcagatgct acttgactta cgatggtgtt
901 acttcctgat aaactcgtcg taagttgaaa atattatccg tgggcgtgag cgcttcgaga
961 tgttccgaga gctgaatgag gccttggaac tcaaggatgc ccaggctggg aaggagccag
1021 gggggagcag ggctcactcc agccacctga agtccaaaaa gggtcagtct acctcccgcc
1081 ataaaaaact catgttcaag acagaagggc ctgactcaga ctgacattct ccacttcttg
1141 ttccccactg acagcctccc acccccatct ctccctcccc tgccattttg ggttttgggt
1201 ctttgaaccc ttgcttgcaa taggtgtgcg tcagaagcac ccaggacttc catttgcttt TABLE 1-continued

```
1261 gtcccggggc tccactgaac aagttggcct gcactggtgt tttgttgtgg ggaggaggat
1321 ggggagtagg acataccagc ttagatttta aggtttttac tgtgagggat gtttgggaga
1381 tgtaagaaat gttcttgcag ttaagggtta gtttacaatc agccacattc taggtagggg
1441 cccacttcac cgtactaacc agggaagctg tccctcactg ttgaattttc tctaacttca
1501 aggcccatat ctgtgaaatg ctggcatttg cacctacctc acagagtgca ttgtgagggt
1561 taatgaaata atgtacatct ggccttgaaa ccacctttta ttacatgggg tctagaactt
1621 gacccccttg agggtgcttg ttccctctcc ctgttggtcg gtgggttggt agtttctaca
1681 gttgggcagc tggttaggta gagggagttg tcaagtctct gctggcccag ccaaaccctg
1741 tctgacaacc tcttggtgaa ccttagtacc taaaaggaaa tctcacccca tcccacaccc
1801 tggaggattt catctcttgt atatgatgat ctggatccac caagacttgt tttatgctca
1861 gggtcaattt ctttttcttt tttttttttt tttttctttt ttctttgaga ctgggtctcg
1921 ctttgttgcc caggctggag tggagtggcg tgatcttggc ttactgcagc ctttgcctcc
1981 ccggctcgag cagtcctgcc tcagcctccg gagtagctgg gaccacaggt tcatgccacc
2041 atggccagcc aacttttgca tgttttgtag agatggggtc tcacagtgtt gcccaggctg
2101 gtctcaaact cctgggctca ggcgatccac ctgtctcagc ctcccagagt gctgggatta
2161 caattgtgag ccaccacgtc cagctggaag ggtcaacatc ttttacattc tgcaagcaca
2221 tctgcatttt caccccaccc ttcccctcct tctccctttt tatatcccat ttttatatcg
2281 atctcttatt ttacaataaa actttgctgc cacctgtgtg tctgaggggt g
```

SEQ ID NO: 84 Human TP53 isoform g Amino Acid Sequence (NP_001119590.1, NP_001263689.1, and NP_001263690.1)

```
  1 mddlmlspdd ieqwftedpg pdeaprmpea appvapapaa ptpaapapap swplsssvps
 61 qktyqgsygf rlgflhsgta ksvtctyspa lnkmfcqlak tcpvqlwvds tpppgtrvra
121 maiykqsqhm tevvrrcphh ercsdsdgla ppqhlirveg nlrveylddr ntfrhsvvvp
181 yeppevgsdc ttihynymcn sscmggmnrr piltiitled ssgnllgrns fevrvcacpg
241 rdrrteeenl rkkgephhel ppgstkralp nntssspqpk kkpldgeyft lqirgrerfe
301 mfrelneale lkdaqagkep ggsrahsshl kskkgqstsr hkklmfkteg pdsd
```

SEQ ID NO: 85 Human TP53 transcript variant 8 cDNA sequence (NM_001126118.1; CDS: 437-1501)

```
   1 gatgggattg gggttttccc ctcccatgtg ctcaagactg gcgctaaaag ttttgagctt
  61 ctcaaaagtc tagagccacc gtccagggag caggtagctg ctgggctccg gggacacttt
 121 gcgttcgggc tgggagcgtg ctttccacga cggtgacacg cttccctgga ttggcagcca
 181 gactgccttc cgggtcactg ccatggagga gccgcagtca gatcctagcg tcgagccccc
 241 tctgagtcag gaaacatttt cagacctatg gaaactgtga gtggatccat tggaagggca
 301 ggcccaccac ccccacccca accccagccc cctagcagag acctgtggga agcgaaaatt
 361 ccatgggact gactttctgc tcttgtcttt cagacttcct gaaaacaacg ttctgtcccc
 421 cttgccgtcc caagcaatgg atgatttgat gctgtccccg gacgatattg aacaatggtt
 481 cactgaagac ccaggtccag atgaagctcc cagaatgcca gaggctgctc cccccgtggc
 541 ccctgcacca gcagctccta caccggcggc ccctgcacca gccccctcct ggcccctgtc
 601 atcttctgtc ccttcccaga aaacctacca gggcagctac ggtttccgtc tgggcttctt
 661 gcattctggg acagccaagt ctgtgacttg cacgtactcc cctgccctca acaagatgtt
 721 ttgccaactg gccaagacct gccctgtgca gctgtgggtt gattccacac ccccgcccgg
 781 cacccgcgtc cgcgccatgg ccatctacaa gcagtcacag cacatgacgg aggttgtgag
 841 gcgctgcccc caccatgagc gctgctcaga tagcgatggt ctggcccctc ctcagcatct
 901 tatccgagtg gaaggaaatt tgcgtgtgga gtatttggat gacagaaaca cttttcgaca
 961 tagtgtggtg gtgccctatg agccgcctga ggttggctct gactgtacca ccatccacta
1021 caactacatg tgtaacagtt cctgcatggg cggcatgaac cggaggccca tcctcaccat
1081 catcacactg gaagactcca gtggtaatct actgggacgg aacagctttg aggtgcgtgt
1141 ttgtgcctgt cctgggagag accggcgcac agaggaagag aatctccgca agaaagggga
1201 gcctcaccac gagctgcccc cagggagcac taagcgagca ctgcccaaca acaccagctc
1261 ctctccccag ccaaagaaga aaccactgga tggagaatat ttcacccttc agatccgtgg
1321 gcgtgagcgc ttcgagatgt tccgagagct gaatgaggcc ttggaactca aggatgccca
1381 ggctgggaag gagccagggg ggagcagggc tcactccagc cacctgaagt ccaaaaaggg
1441 tcagtctacc tcccgccata aaaaactcat gttcaagaca gaagggcctg actcagactg
1501 acattctcca cttcttgttc cccactgaca gcctcccacc cccatctctc cctcccctgc
1561 catttgggt tttgggtctt tgaacccttg cttgcaatag gtgtgcgtca gaagcaccca
1621 ggacttccat ttgctttgtc ccggggctcc actgaacaag ttggcctgca ctggtgtttt
1681 gttgtgggga ggaggatggg gagtaggaca taccagctta gattttaagg tttttactgt
1741 gagggatgtt tgggagatgt aagaaatgtt cttgcagtta agggttagtt tacaatcagc
1801 cacattctag gtaggggccc acttcaccgt actaaccagg gaagctgtcc ctcactgttg
1861 aattttctct aacttcaagg cccatatctg tgaaatgctg gcatttgcac ctacctcaca
1921 gagtgcattg tgagggttaa tgaaataatg tacatctggc cttgaaacca ccttttatta
1981 catggggtct agaacttgac ccccttgagg gtgcttgttc cctctccctg ttggtcggtg
2041 ggttggtagt ttctacagtt gggcagctgg ttaggtagag ggagttgtca agtctctgct
2101 ggcccagcca aaccctgtct gacaacctct tggtgaacct tagtacctaa aaggaaatct
2161 caccccatcc cacaccctgg aggatttcat ctcttgtata tgatgatctg gatccaccaa
2221 gacttgtttt atgctcaggg tcaatttctt ttttcttttt tttttttttt tttcttttttc
2281 tttgagactg ggtctcgctt tgttgcccag gctggagtgg agtggcgtga tcttggctta
2341 ctgcagcctt tgcctccccg gctcgagcag tcctgcctca gcctccggag tagctgggac
2401 cacaggttca tgccaccatg gccagccaac ttttgcatgt tttgtagaga tggggtctca
2461 cagtgttgcc caggctggtc tcaaactcct gggctcaggc gatccacctg tctcagcctc
2521 ccagagtgct gggattacaa ttgtgagcca ccacgtccag ctggaagggt caacatcttt
2581 tacattctgc aagcacatct gcattttcac cccacccttc ccctccttct ccctttttat
2641 atcccatttt tatatcgatc tcttatttta caataaaact ttgctgccac ctgtgtgtct
2701 gaggggtg
```

TABLE 1-continued

SEQ ID NO: 86 Human TP53 transcript variant 1 cDNA Sequence
(NM_001276760.1; CDS: 320-1384)
1 gatgggattg gggttttccc ctcccatgtg ctcaagactg gcgctaaaag ttttgagctt
61 ctcaaaagtc tagagccacc gtccagggag caggtagctg ctgggctccg gggacacttt
121 gcgttcgggc tgggagcgtg ctttccacga cggtgacacg cttccctgga ttggcagcca
181 gactgccttc cgggtcactg ccatggagga gccgcagtca gatcctagcg tcgagccccc
241 tctgagtcag gaaacatttt cagacctatg gaaactactt cctgaaaaca acgttctgtc
301 ccccttgccg tcccaagcaa tggatgattt gatgctgtcc ccggacgata ttgaacaatg
361 gttcactgaa gacccaggtc cagatgaagc tcccagaatg ccagaggctg ctccccccgt
421 ggcccctgca ccagcagctc ctacaccggc ggcccctgca ccagccccct cctggcccct
481 gtcatcttct gtcccttccc agaaaaccta ccagggcagc tacggtttcc gtctgggctt
541 cttgcattct gggacagcca agtctgtgac ttgcacgtac tcccctgccc tcaacaagat
601 gttttgccaa ctggccaaga cctgccctgt gcagctgtgg gttgattcca caccccgcc
661 cggcacccgc gtccgcgcca tggccatcta caagcagtca cagcacatga cggaggttgt
721 gaggcgctgc ccccaccatg agcgctgctc agatagcgat ggtctggccc ctcctcagca
781 tcttatccga gtggaaggaa atttgcgtgt ggagtatttg gatgacagaa acacttttcg
841 acatagtgtg gtggtgccct atgagccgcc tgaggttggc tctgactgta ccaccatcca
901 ctacaactac atgtgtaaca gttcctgcat gggcggcatg aaccggaggc ccatcctcac
961 catcatcaca ctggaagact ccagtggtaa tctactggga cggaacagct ttgaggtgcg
1021 tgtttgtgcc tgtcctggga gagaccggcg cacagaggaa gagaatctcc gcaagaaagg
1081 ggagcctcac cacgagctgc ccccagggag cactaagcga gcactgccca acaacaccag
1141 ctcctctccc cagccaaaga agaaaccact ggatggagaa tatttcaccc ttcagatccg
1201 tgggcgtgag cgcttcgaga tgttccgaga gctgaatgag gccttggaac tcaaggatgc
1261 ccaggctggg aaggagccag gggggagcag ggctcactcc agccacctga agtccaaaaa
1321 gggtcagtct acctcccgcc ataaaaaact catgttcaag acagaagggc ctgactcaga
1381 ctgacattct ccacttcttg ttccccactg acagcctccc acccccatct ctccctcccc
1441 tgccattttg ggttttgggt ctttgaaccc ttgcttgcaa taggtgtgcg tcagaagcac
1501 ccaggacttc catttgcttt gtcccggggc tccactgaac aagttggcct gcactggtgt
1561 tttgttgtgg ggaggaggat ggggagtagg acataccagc ttagatttta aggtttttac
1621 tgtgagggat gtttgggaga tgtaagaaat gttcttgcag ttaagggtta gtttacaatc
1681 agccacattc taggtagggg cccacttcac cgtactaacc agggaagctg tccctcactg
1741 ttgaattttc tctaacttca aggcccatat ctgtgaaatg ctggcatttg cacctacctc
1801 acagagtgca ttgtgagggt taatgaaata atgtacatct ggccttgaaa ccacctttta
1861 ttacatgggg tctagaactt gacccccttg agggtgcttg ttccctctcc ctgttggtcg
1921 gtgggttggt agtttctaca gttgggcagc tggttaggta gagggagttg tcaagtctct
1981 gctggcccag ccaaaccctg tctgacaacc tcttggtgaa ccttagtacc taaaaggaaa
2041 tctcacccca tcccacaccc tggaggattt catctcttgt atatgatgat ctggatccac
2101 caagacttgt tttatgctca gggtcaattt cttttttctt tttttttttt tttttttcttt
2161 ttctttgaga ctgggtctcg ctttgttgcc caggctggag tggagtggcg tgatcttggc
2221 ttactgcagc ctttgcctcc ccggctcgag cagtcctgcc tcagcctccg gagtagctgg
2281 gaccacaggt tcatgccacc atggccagcc aacttttgca tgttttgtag agatggggtc
2341 tcacagtgtt gcccaggctg gtctcaaact cctgggctca ggcgatccac ctgtctcagc
2401 ctcccagagt gctgggatta caattgtgag ccaccacgtc cagctggaag ggtcaacatc
2461 ttttacattc tgcaagcaca tctgcatttt caccccaccc ttcccctcct tctccctttt
2521 tatatcccat ttttatatcg atctcttatt ttacaataaa actttgctgc cacctgtgtg
2581 tctgaggggt g SEQ ID NO: 87 Human TP53 transcript variant 2 cDNA Sequence
(NM_001276761.1; CDS: 317-1381)
1 gatgggattg gggttttccc ctcccatgtg ctcaagactg gcgctaaaag ttttgagctt
61 ctcaaaagtc tagagccacc gtccagggag caggtagctg ctgggctccg gggacacttt
121 gcgttcgggc tgggagcgtg ctttccacga cggtgacacg cttccctgga ttggccagac
181 tgccttccgg gtcactgcca tggaggagcc gcagtcagat cctagcgtcg agccccctct
241 gagtcaggaa acattttcag acctatggaa actacttcct gaaaacaacg ttctgtcccc
301 cttgccgtcc caagcaatgg atgatttgat gctgtccccg gacgatattg aacaatggtt
361 cactgaagac ccaggtccag atgaagctcc cagaatgcca gaggctgctc cccccgtggc
421 ccctgcacca gcagctccta caccggcggc ccctgcacca gccccctcct ggcccctgtc
481 atcttctgtc ccttcccaga aaacctacca gggcagctac ggtttccgtc tgggcttctt
541 gcattctggg acagccaagt ctgtgacttg cacgtactcc cctgccctca acaagatgtt
601 ttgccaactg gccaagacct gccctgtgca gctgtgggtt gattccacac ccccgcccgg
661 cacccgcgtc cgcgccatgg ccatctacaa gcagtcacag cacatgacgg aggttgtgag
721 gcgctgcccc caccatgagc gctgctcaga tagcgatggt ctggcccctc ctcagcatct
781 tatccgagtg gaaggaaatt tgcgtgtgga gtatttggat gacagaaaca cttttcgaca
841 tagtgtggtg gtgccctatg agccgcctga ggttggctct gactgtacca ccatccacta
901 caactacatg tgtaacagtt cctgcatggg cggcatgaac cggaggccca tcctcaccat
961 catcacactg gaagactcca gtggtaatct actgggacgg aacagctttg aggtgcgtgt
1021 ttgtgcctgt cctgggagag accggcgcac agaggaagag aatctccgca agaaagggga
1081 gcctcaccac gagctgcccc cagggagcac taagcgagca ctgcccaaca acaccagctc
1141 ctctccccag ccaaagaaga aaccactgga tggagaatat ttcacccttc agatccgtgg
1201 gcgtgagcgc ttcgagatgt tccgagagct gaatgaggcc ttggaactca aggatgccca
1261 ggctgggaag gagccagggg ggagcagggc tcactccagc cacctgaagt ccaaaaaggg
1321 tcagtctacc tcccgccata aaaaactcat gttcaagaca gaagggcctg actcagactg
1381 acattctcca cttcttgttc cccactgaca gcctcccacc cccatctctc cctcccctgc
1441 cattttgggt tttgggtctt tgaacccttg cttgcaatag gtgtgcgtca gaagcaccca
1501 ggacttccat ttgctttgtc ccggggctcc actgaacaag ttggcctgca ctggtgtttt
1561 gttgtgggga ggaggatggg gagtaggaca taccagctta gattttaagg tttttactgt
1621 gagggatgtt tgggagatgt aagaaatgtt cttgcagtta agggttagtt tacaatcagc
1681 cacattctag gtaggggccc acttcaccgt actaaccagg gaagctgtcc ctcactgttg
1741 aattttctct aacttcaagg cccatatctg tgaaatgctg gcatttgcac ctacctcaca TABLE 1-continued

```
1801 gagtgcattg tgagggttaa tgaaataatg tacatctggc cttgaaacca ccttttatta
1861 catggggtct agaacttgac cccttgagg gtgcttgttc cctctccctg ttggtcggtg
1921 ggttggtagt ttctacagtt gggcagctgg ttaggtagag ggagttgtca agtctctgct
1981 ggcccagcca aaccctgtct gacaacctct tggtgaacct tagtacctaa aaggaaatct
2041 caccccatcc cacaccctgg aggatttcat ctcttgtata tgatgatctg gatccaccaa
2101 gacttgtttt atgctcaggg tcaatttctt ttttcttttt tttttttttt tttctttttc
2161 tttgagactg ggtctcgctt tgttgcccag gctggagtgg agtggcgtga tcttggctta
2221 ctgcagcctt tgcctccccg gctcgagcag tcctgcctca gcctccggag tagctgggac
2281 cacaggttca tgccaccatg gccagccaac ttttgcatgt tttgtagaga tggggtctca
2341 cagtgttgcc caggctggtc tcaaactcct gggctcaggc gatccacctg tctcagcctc
2401 ccagagtgct gggattacaa ttgtgagcca ccacgtccag ctggaagggt caacatcttt
2461 tacattctgc aagcacatct gcattttcac cccacccttc ccctccttct cccttttttat
2521 atcccatttt tatatcgatc tcttatttta caataaaact ttgctgccac ctgtgtgtct
2581 gaggggtg
```

SEQ ID NO: 88 Human TP53 isoform h Amino Acid Sequence (NP_001263624.1)

```
  1 mddlmlspdd ieqwftedpg pdeaprmpea appvapapaa ptpaapapap swplsssvps
 61 qktyqgsygf rlgflhsgta ksvtctyspa lnkmfcqlak tcpvqlwvds tpppgtrvra
121 maiykqsqhm tevvrrcphh ercsdsdgla ppqhlirveg nlrveylddr ntfrhsvvvp
181 yeppevgsdc ttihynymcn sscmggmnrr piltiitled ssgnllgrns fevrvcacpg
241 rdrrteeenl rkkgephhel ppgstkralp nntssspqpk kkpldgeyft lqmlldlrwc
301 yflinss
```

SEQ ID NO: 89 Human TP53 transcript variant 4 cDNA Sequence (NM_001276695.1; CDS: 320-1243)

```
   1 gatgggattg gggttttccc ctcccatgtg ctcaagactg gcgctaaaag ttttgagctt
  61 ctcaaaagtc tagagccacc gtccagggag caggtagctg ctgggctccg gggacacttt
 121 gcgttcgggc tgggagcgtg ctttccacga cggtgacacg cttccctgga ttggcagcca
 181 gactgccttc cgggtcactg ccatggagga gccgcagtca gatcctagcg tcgagccccc
 241 tctgagtcag gaaacatttt cagacctatg gaaactactt cctgaaaaca acgttctgtc
 301 ccccttgccg tcccaagcaa tggatgattt gatgctgtcc ccggacgata ttgaacaatg
 361 gttcactgaa gacccaggtc cagatgaagc tcccagaatg ccagaggctg ctcccccgt
 421 ggcccctgca ccagcagctc ctacaccggc ggcccctgca ccagccccct cctggcccct
 481 gtcatcttct gtcccttccc agaaaaccta ccagggcagc tacggtttcc gtctgggctt
 541 cttgcattct gggacagcca agtctgtgac ttgcacgtac tcccctgccc tcaacaagat
 601 gttttgccaa ctggccaaga cctgccctgt gcagctgtgg gttgattcca cacccccgcc
 661 cggcacccgc gtccgcgcca tggccatcta caagcagtca cagcacatga cggaggttgt
 721 gaggcgctgc ccccaccatg agcgctgctc agatagcgat ggtctggccc ctcctcagca
 781 tcttatccga gtggaaggaa atttgcgtgt ggagtatttg gatgacagaa acacttttcg
 841 acatagtgtg gtggtgccct atgagccgcc tgaggttggc tctgactgta ccaccatcca
 901 ctacaactac atgtgtaaca gttcctgcat gggcggcatg aaccggaggc ccatcctcac
 961 catcatcaca ctggaagact ccagtggtaa tctactggga cggaacagct ttgaggtgcg
1021 tgtttgtgcc tgtcctggga gagaccggcg cacagaggaa gagaatctcc gcaagaaagg
1081 ggagcctcac cacgagctgc ccccagggag cactaagcga gcactgccca acaacaccag
1141 ctcctctccc cagccaaaga agaaaccact ggatggagaa tatttcaccc ttcagatgct
1201 acttgactta cgatggtgtt acttcctgat aaactcgtcg taagttgaaa atattatccg
1261 tgggcgtgag cgcttcgaga tgttccgaga gctgaatgag gccttggaac tcaaggatgc
1321 ccaggctggg aaggagccag gggggagcag ggctcactcc agccacctga agtccaaaaa
1381 gggtcagtct acctcccgcc ataaaaaact catgttcaag acagaagggc ctgactcaga
1441 ctgacattct ccacttcttg ttccccactg acagcctccc acccccatct ctccctcccc
1501 tgccattttg ggttttgggt ctttgaaccc ttgcttgcaa taggtgtgcg tcagaagcac
1561 ccaggacttc catttgcttt gtcccggggc tccactgaac aagttggcct gcactggtgt
1621 tttgttgtgg ggaggaggat ggggagtagg acataccagc ttagatttta aggtttttac
1681 tgtgagggat gtttgggaga tgtaagaaat gttcttgcag ttaagggtta gtttacaatc
1741 agccacattc taggtagggg cccacttcac cgtactaacc agggaagctg tccctcactg
1801 ttgaattttc tctaacttca aggcccatat ctgtgaaatg ctggcatttg cacctacctc
1861 acagagtgca ttgtgagggt taatgaaata atgtacatct ggccttgaaa ccacctttta
1921 ttacatgggg tctagaactt gaccccttg agggtgcttg ttccctctcc ctgttggtcg
1981 gtgggttggt agtttctaca gttgggcagc tggttaggta gagggagttg tcaagtctct
2041 gctggcccag ccaaaccctg tctgacaacc tcttggtgaa ccttagtacc taaaaggaaa
2101 tctcacccca tcccacaccc tggaggattt catctcttgt atatgatgat ctggatccac
2161 caagacttgt tttatgctca gggtcaattt ctttttttctt tttttttttt tttttctttt
2221 ttctttgaga ctgggtctcg ctttgttgcc caggctggag tggagtggcg tgatcttggc
2281 ttactgcagc ctttgcctcc ccggctcgag cagtcctgcc tcagcctccg gagtagctgg
2341 gaccacaggt tcatgccacc atggccagcc aacttttgca tgttttgtag agatggggtc
2401 tcacagtgtt gcccaggctg gtctcaaact cctgggctca ggcgatccac ctgtctcagc
2461 ctcccagagt gctgggatta caattgtgag ccaccacgtc cagctggaag ggtcaacatc
2521 ttttacattc tgcaagcaca tctgcatttt caccccaccc ttcccctcct tctccctttt
2581 tatatcccat ttttatatcg atctcttatt ttacaataaa actttgctgc cacctgtgtg
2641 tctgaggggt g
```

SEQ ID NO: 90 Human TP53 isoform i Amino Acid Sequence (NP_001263625.1)

```
  1 mddlmlspdd ieqwftedpg pdeaprmpea appvapapaa ptpaapapap swplsssvps
 61 qktyqgsygf rlgflhsgta ksvtctyspa lnkmfcqlak tcpvqlwvds tpppgtrvra
121 maiykqsqhm tevvrrcphh ercsdsdgla ppqhlirveg nlrveylddr ntfrhsvvvp
181 yeppevgsdc ttihynymcn sscmggmnrr piltiitled ssgnllgrns fevrvcacpg
241 rdrrteeenl rkkgephhel ppgstkralp nntsssspqpk kkpldgeyft lqdqtsfqke
301 nc
```

TABLE 1-continued

SEQ ID NO: 91 Human TP53 transcript variant 3 cDNA sequence
(NM_001276696.1 CDS: 320-1228)

```
   1 gatgggattg gggttttccc ctcccatgtg ctcaagactg gcgctaaaag ttttgagctt
  61 ctcaaaagtc tagagccacc gtccagggag caggtagctg ctgggctccg gggacacttt
 121 gcgttcgggc tgggagcgtg ctttccacga cggtgacacg cttccctgga ttggcagcca
 181 gactgccttc cgggtcactg ccatggagga gccgcagtca gatcctagcg tcgagccccc
 241 tctgagtcag gaaacatttt cagacctatg gaaactactt cctgaaaaca acgttctgtc
 301 ccccttgccg tcccaagcaa tggatgattt gatgctgtcc ccggacgata ttgaacaatg
 361 gttcactgaa gacccaggtc cagatgaagc tcccagaatg ccagaggctg ctccccccgt
 421 ggcccctgca ccagcagctc ctacaccggc ggcccctgca ccagcccccct cctggcccct
 481 gtcatcttct gtcccttccc agaaaaccta ccagggcagc tacggtttcc gtctgggctt
 541 cttgcattct gggacagcca agtctgtgac ttgcacgtac tcccctgccc tcaacaagat
 601 gttttgccaa ctggccaaga cctgccctgt gcagctgtgg gttgattcca cacccccgcc
 661 cggcacccgc gtccgcgcca tggccatcta caagcagtca cagcacatga cggaggttgt
 721 gaggcgctgc ccccaccatg agcgctgctc agatagcgat ggtctggccc ctcctcagca
 781 tcttatccga gtggaaggaa atttgcgtgt ggagtatttg gatgacagaa acacttttcg
 841 acatagtgtg gtggtgccct atgagccgcc tgaggttggc tctgactgta ccaccatcca
 901 ctacaactac atgtgtaaca gttcctgcat gggcggcatg aaccggaggc ccatcctcac
 961 catcatcaca ctggaagact ccagtggtaa tctactggga cggaacagct ttgaggtgcg
1021 tgtttgtgcc tgtcctggga gagaccggcg cacagaggaa gagaatctcc gcaagaaagg
1081 ggagcctcac cacgagctgc ccccagggag cactaagcga gcactgccca acaacaccag
1141 ctcctctccc cagccaaaga agaaaccact ggatggagaa tatttcaccc ttcaggacca
1201 gaccagcttt caaaaagaaa attgttaaag agagcatgaa aatggttcta tgactttgcc
1261 tgatacagat gctacttgac ttacgatggt gttacttcct gataaactcg tcgtaagttg
1321 aaaatattat ccgtgggcgt gagcgcttcg agatgttccg agagctgaat gaggccttgg
1381 aactcaagga tgcccaggct gggaaggagc caggggggag cagggctcac tccagccacc
1441 tgaagtccaa aaagggtcag tctacctccc gccataaaaa actcatgttc aagacagaag
1501 ggcctgactc agactgacat tctccacttc ttgttcccca ctgacagcct cccaccccca
1561 tctctccctc ccctgccatt ttgggttttg ggtctttgaa cccttgcttg caataggtgt
1621 gcgtcagaag cacccaggac ttccatttgc tttgtcccgg ggctccactg aacaagttgg
1681 cctgcactgg tgttttgttg tggggaggag gatggggagt aggacatacc agcttagatt
1741 ttaaggtttt tactgtgagg gatgtttggg agatgtaaga aatgttcttg cagttaaggg
1801 ttagtttaca atcagccaca ttctaggtag ggcccactt caccgtacta accagggaag
1861 ctgtccctca ctgttgaatt ttctctaact tcaaggccca tatctgtgaa atgctggcat
1921 ttgcacctac ctcacagagt gcattgtgag ggttaatgaa ataatgtaca tctggccttg
1981 aaaccacctt ttattacatg gggtctagaa cttgaccccc ttgagggtgc ttgttccctc
2041 tccctgttgg tcggtgggtt ggtagtttct acagttgggc agctggttag gtagagggag
2101 ttgtcaagtc tctgctggcc cagccaaacc ctgtctgaca acctcttggt gaaccttagt
2161 acctaaaagg aaatctcacc ccatcccaca ccctggagga tttcatctct tgtatatgat
2221 gatctggatc caccaagact tgttttatgc tcagggtcaa tttctttttt cttttttttt
2281 tttttttttc tttttctttg agactgggtc tcgctttgtt gcccaggctg gagtggagtg
2341 gcgtgatctt ggcttactgc agcctttgcc tccccggctc gagcagtcct gcctcagcct
2401 ccggagtagc tgggaccaca ggttcatgcc accatggcca gccaactttt gcatgttttg
2461 tagagatggg gtctcacagt gttgcccagg ctggtctcaa actcctgggc tcaggcgatc
2521 cacctgtctc agcctcccag agtgctggga ttacaattgt gagccaccac gtccagctgg
2581 aagggtcaac atcttttaca ttctgcaagc acatctgcat tttcacccca cccttcccct
2641 ccttctccct ttttatatcc catttttata tcgatctctt attttacaat aaaactttgc
2701 tgccacctgt gtgtctgagg ggtg
```

SEQ ID NO: 92 Human TP53 isoform j Amino Acid Sequence (NP_001263626.1)

```
   1 maiykqsqhm tevvrrcphh ercsdsdgla ppqhlirveg nlrveylddr ntfrhsvvvp
  61 yeppevgsdc ttihynymcn sscmggmnrr piltiitled ssgnllgrns fevrvcacpg
 121 rdrrteeenl rkkgephhel ppgstkralp nntssspqpk kkpldgeyft lqirgrerfe
 181 mfrelneale lkdaqagkep ggsrahsshl kskkgqstsr hkklmfkteg pdsd
```

SEQ ID NO: 93 Human TP53 transcript variant 5 cDNA sequence
(NM_001276697.1; CDS: 360-1064)

```
   1 tgaggccagg agatggaggc tgcagtgagc tgtgatcaca ccactgtgct ccagcctgag
  61 tgacagagca agaccctatc tcaaaaaaaa aaaaaaaaaa gaaaagctcc tgaggtgtag
 121 acgccaactc tctctagctc gctagtgggt tgcaggaggt gcttacgcat gtttgtttct
 181 ttgctgccgt cttccagttg ctttatctgt tcacttgtgc cctgactttc aactctgtct
 241 ccttcctctt cctacagtac tcccctgccc tcaacaagat gttttgccaa ctggccaaga
 301 cctgccctgt gcagctgtgg gttgattcca cacccccgcc cggcacccgc gtccgcgcca
 361 tggccatcta caagcagtca cagcacatga cggaggttgt gaggcgctgc ccccaccatg
 421 agcgctgctc agatagcgat ggtctggccc ctcctcagca tcttatccga gtggaaggaa
 481 atttgcgtgt ggagtatttg gatgacagaa acacttttcg acatagtgtg gtggtgccct
 541 atgagccgcc tgaggttggc tctgactgta ccaccatcca ctacaactac atgtgtaaca
 601 gttcctgcat gggcggcatg aaccggaggc ccatcctcac catcatcaca ctggaagact
 661 ccagtggtaa tctactggga cggaacagct ttgaggtgcg tgtttgtgcc tgtcctggga
 721 gagaccggcg cacagaggaa gagaatctcc gcaagaaagg ggagcctcac cacgagctgc
 781 ccccagggag cactaagcga gcactgccca acaacaccag ctcctctccc cagccaaaga
 841 agaaaccact ggatggagaa tatttcaccc ttcagatccg tgggcgtgag cgcttcgaga
 901 tgttccgaga gctgaatgag gccttggaac tcaaggatgc ccaggctggg aaggagccag
 961 gggggagcag ggctcactcc agccacctga agtccaaaaa gggtcagtct acctcccgcc
1021 ataaaaaact catgttcaag acagaagggc ctgactcaga ctgacattct ccacttcttg
1081 ttccccactg acagcctccc acccccatct ctccctcccc tgccattttg ggttttgggt
1141 ctttgaaccc ttgcttgcaa taggtgtgcg tcagaagcac ccaggacttc catttgcttt
1201 gtcccggggc tccactgaac aagttggcct gcactggtgt tttgttgtgg ggaggaggat
1261 ggggagtagg acataccagc ttagatttta aggtttttac tgtgagggat gtttgggaga
1321 tgtaagaaat gttcttgcag ttaagggtta gtttacaatc agccacattc taggtagggg
```

TABLE 1-continued

```
1381 cccacttcac cgtactaacc agggaagctg tccctcactg ttgaattttc tctaacttca
1441 aggcccatat ctgtgaaatg ctggcatttg cacctacctc acagagtgca ttgtgagggt
1501 taatgaaata atgtacatct ggccttgaaa ccacctttta ttacatgggg tctagaactt
1561 gaccccccttg agggtgcttg ttccctctcc ctgttggtcg gtgggttggt agtttctaca
1621 gttgggcagc tggttaggta gagggagttg tcaagtctct gctggcccag ccaaaccctg
1681 tctgacaacc tcttggtgaa ccttagtacc taaaaggaaa tctcacccca tcccacaccc
1741 tggaggattt catctcttgt atatgatgat ctggatccac caagacttgt tttatgctca
1801 gggtcaattt cttttttctt tttttttttt tttttctttt ttctttgaga ctgggtctcg
1861 ctttgttgcc caggctggag tggagtggcg tgatcttggc ttactgcagc ctttgcctcc
1921 ccggctcgag cagtcctgcc tcagcctccg gagtagctgg gaccacaggt tcatgccacc
1981 atggccagcc aacttttgca tgttttgtag agatggggtc tcacagtgtt gcccaggctg
2041 gtctcaaact cctgggctca ggcgatccac ctgtctcagc ctcccagagt gctgggatta
2101 caattgtgag ccaccacgtc cagctggaag ggtcaacatc ttttacattc tgcaagcaca
2161 tctgcatttt caccccaccc ttcccctcct tctccctttt tatatcccat ttttatatcg
2221 atctcttatt ttacaataaa actttgctgc cacctgtgtg tctgaggggt g
```

SEQ ID NO: 94 Human TP53 isoform k Amino Acid Sequence (NP_001263627.1)

```
  1 maiykqsqhm tevvrrcphh ercsdsdgla ppqhlirveg nlrveylddr ntfrhsvvvp
 61 yeppevgsdc ttihynymcn sscmggmnrr piltiitled ssgnllgrns fevrvcacpg
121 rdrrteeenl rkkgephhel ppgstkralp nntssspqpk kkpldgeyft lqdqtsfqke
181 nc
```

SEQ ID NO: 95 Human TP53 transcript variant 6 cDNA sequence (NM_001276698.1; CDS: 360-908)

```
   1 tgaggccagg agatggaggc tgcagtgagc tgtgatcaca ccactgtgct ccagcctgag
  61 tgacagagca agaccctatc tcaaaaaaaa aaaaaaaaaa gaaaagctcc tgaggtgtag
 121 acgccaactc tctctagctc gctagtgggt tgcaggaggt gcttacgcat gtttgtttct
 181 ttgctgccgt cttccagttg ctttatctgt tcacttgtgc cctgactttc aactctgtct
 241 ccttcctctt cctacagtac tcccctgccc tcaacaagat gttttgccaa ctggccaaga
 301 cctgccctgt gcagctgtgg gttgattcca caccccccgcc cggcacccgc gtccgcgcca
 361 tggccatcta caagcagtca cagcacatga cggaggttgt gaggcgctgc ccccaccatg
 421 agcgctgctc agatagcgat ggtctggccc ctcctcagca tcttatccga gtggaaggaa
 481 atttgcgtgt ggagtatttg gatgacagaa acacttttcg acatagtgtg gtggtgccct
 541 atgagccgcc tgaggttggc tctgactgta ccaccatcca ctacaactac atgtgtaaca
 601 gttcctgcat gggcggcatg aaccggaggc ccatcctcac catcatcaca ctggaagact
 661 ccagtggtaa tctactggga cggaacagct ttgaggtgcg tgtttgtgcc tgtcctggga
 721 gagaccggcg cacagaggaa gagaatctcc gcaagaaagg ggagcctcac cacgagctgc
 781 ccccagggag cactaagcga gcactgccca acaacaccag ctcctctccc cagccaaaga
 841 agaaaccact ggatggagaa tatttcaccc ttcaggacca gaccagcttt caaaaagaaa
 901 attgttaaag agagcatgaa aatggttcta tgactttgcc tgatacagat gctacttgac
 961 ttacgatggt gttacttcct gataaactcg tcgtaagttg aaaatattat ccgtgggcgt
1021 gagcgcttcg agatgttccg agagctgaat gaggccttgg aactcaagga tgcccaggct
1081 gggaaggagc caggggggag cagggctcac tccagccacc tgaagtccaa aaagggtcag
1141 tctacctccc gccataaaaa actcatgttc aagacagaag ggcctgactc agactgacat
1201 tctccacttc ttgttcccca ctgacagcct cccaccccca tctctccctc ccctgccatt
1261 ttgggttttg ggtctttgaa cccttgcttg caataggtgt gcgtcagaag cacccaggac
1321 ttccatttgc tttgtcccgg ggctccactg aacaagttgg cctgcactgg tgttttgttg
1381 tggggaggag gatggggagt aggacatacc agcttagatt ttaaggtttt tactgtgagg
1441 gatgtttggg agatgtaaga aatgttcttg cagttaaggg ttagtttaca atcagccaca
1501 ttctaggtag gggcccactt caccgtacta accagggaag ctgtccctca ctgttgaatt
1561 ttctctaact tcaaggccca tatctgtgaa atgctggcat ttgcacctac ctcacagagt
1621 gcattgtgag ggttaatgaa ataatgtaca tctggccttg aaaccacctt ttattacatg
1681 gggtctagaa cttgaccccc ttgagggtgc ttgttccctc tccctgttgg tcggtgggtt
1741 ggtagtttct acagttgggc agctggttag gtagagggag ttgtcaagtc tctgctggcc
1801 cagccaaacc ctgtctgaca acctcttggt gaaccttagt acctaaaagg aaatctcacc
1861 ccatccccaca ccctggagga tttcatctct tgtatatgat gatctggatc caccaagact
1921 tgttttatgc tcagggtcaa tttctttttt cttttttttt tttttttttc tttttctttg
1981 agactgggtc tcgctttgtt gcccaggctg gagtggagtg gcgtgatctt ggcttactgc
2041 agcctttgcc tccccggctc gagcagtcct gcctcagcct ccggagtagc tgggaccaca
2101 ggttcatgcc accatggcca gccaactttt gcatgttttg tagagatggg gtctcacagt
2161 gttgcccagg ctggtctcaa actcctgggc tcaggcgatc cacctgtctc agcctcccag
2221 agtgctggga ttacaattgt gagccaccac gtccagctgg aagggtcaac atcttttaca
2281 ttctgcaagc acatctgcat tttcacccca cccttcccct ccttctccct ttttatatcc
2341 catttttata tcgatctctt attttacaat aaaactttgc tgccacctgt gtgtctgagg
2401 ggtg
```

SEQ ID NO: 96 Human TP53 isoform1 Amino Acid Sequence (NP_0012636281)

```
  1 maiykqsqhm tevvrrcphh ercsdsdgla ppqhlirveg nlrveylddr ntfrhsvvvp
 61 yeppevgsdc ttihynymcn sscmggmnrr piltiitled ssgnllgrns fevrvcacpg
121 rdrrteeenl rkkgephhel ppgstkralp nntssspqpk kkpldgeyft lqmlldlrwc
181 yflinss
```

SEQ ID NO: 97 Human TP53 transcript variant 7 cDNA sequence (NM_001276699.1; CDS: 360-923)

```
  1 tgaggccagg agatggaggc tgcagtgagc tgtgatcaca ccactgtgct ccagcctgag
 61 tgacagagca agaccctatc tcaaaaaaaa aaaaaaaaaa gaaaagctcc tgaggtgtag
121 acgccaactc tctctagctc gctagtgggt tgcaggaggt gcttacgcat gtttgtttct
181 ttgctgccgt cttccagttg ctttatctgt tcacttgtgc cctgactttc aactctgtct
241 ccttcctctt cctacagtac tcccctgccc tcaacaagat gttttgccaa ctggccaaga
301 cctgccctgt gcagctgtgg gttgattcca caccccccgcc cggcacccgc gtccgcgcca
```

TABLE 1-continued

```
 361 tggccatcta caagcagtca cagcacatga cggaggttgt gaggcgctgc ccccaccatg
 421 agcgctgctc agatagcgat ggtctggccc ctcctcagca tcttatccga gtggaaggaa
 481 atttgcgtgt ggagtatttg gatgacagaa acacttttcg acatagtgtg gtggtgccct
 541 atgagccgcc tgaggttggc tctgactgta ccaccatcca ctacaactac atgtgtaaca
 601 gttcctgcat gggcggcatg aaccggaggc ccatcctcac catcatcaca ctggaagact
 661 ccagtggtaa tctactggga cggaacagct ttgaggtgcg tgtttgtgcc tgtcctggga
 721 gagaccggcg cacagaggaa gagaatctcc gcaagaaagg ggagcctcac cacgagctgc
 781 ccccagggag cactaagcga gcactgccca acaacaccag ctcctctccc cagccaaaga
 841 agaaaccact ggatggagaa tatttcaccc ttcagatgct acttgactta cgatggtgtt
 901 acttcctgat aaactcgtcg taagttgaaa atattatccg tgggcgtgag cgcttcgaga
 961 tgttccgaga gctgaatgag gccttggaac tcaaggatgc ccaggctggg aaggagccag
1021 gggggagcag ggctcactcc agccacctga agtccaaaaa gggtcagtct acctcccgcc
1081 ataaaaaact catgttcaag acagaagggc ctgactcaga ctgacattct ccacttcttg
1141 ttccccactg acagcctccc acccccatct ctccctcccc tgccattttg ggttttgggt
1201 ctttgaaccc ttgcttgcaa taggtgtgcg tcagaagcac ccaggacttc catttgcttt
1261 gtcccggggc tccactgaac aagttggcct gcactggtgt tttgttgtgg ggaggaggat
1321 ggggagtagg acataccagc ttagatttta aggtttttac tgtgagggat gtttgggaga
1381 tgtaagaaat gttcttgcag ttaagggtta gtttacaatc agccacattc taggtagggg
1441 cccacttcac cgtactaacc agggaagctg tccctcactg ttgaattttc tctaacttca
1501 aggcccatat ctgtgaaatg ctggcatttg cacctacctc acagagtgca ttgtgagggt
1561 taatgaaata atgtacatct ggccttgaaa ccacctttta ttacatgggg tctagaactt
1621 gaccccettg agggtgcttg ttccctctcc ctgttggtcg gtgggttggt agtttctaca
1681 gttgggcagc tggttaggta gagggagttg tcaagtctct gctggcccag ccaaaccctg
1741 tctgacaacc tcttggtgaa ccttagtacc taaaaggaaa tctcacccca tcccacaccc
1801 tggaggattt catctcttgt atatgatgat ctggatccac caagacttgt tttatgctca
1861 gggtcaattt ctttttttctt tttttttttt ttttttcttt ttctttgaga ctgggtctcg
1921 ctttgttgcc caggctggag tggagtggcg tgatcttggc ttactgcagc ctttgcctcc
1981 ccggctcgag cagtcctgcc tcagcctccg gagtagctgg gaccacaggt tcatgccacc
2041 atggccagcc aacttttgca tgttttgtag agatggggtc tcacagtgtt gcccaggctg
2101 gtctcaaact cctgggctca ggcgatccac ctgtctcagc ctcccagagt gctgggatta
2161 caattgtgag ccaccacgtc cagctggaag ggtcaacatc ttttacattc tgcaagcaca
2221 tctgcatttt caccccaccc ttcccctcct tctccctttt tatatcccat ttttatatcg
2281 atctcttatt ttacaataaa actttgctgc cacctgtgtg tctgaggggt g
```

SEQ ID NO: 98 Mouse TP53 isoform b Amino Acid Sequence (NP_001120705.1)

```
   1 mtameesqsd islelplsqe tfsglwkllp pedilpsphc mddlllpqdv eeffegpsea
  61 lrvsgapaaq dpvtetpgpv apapatpwpl ssfvpsqkty qgnygfhlgf lqsgtaksvm
 121 ctysppLnkl fcqlaktcpv qlwvsatppa gsrvramaiy kksqhmtevv rrcphhercs
 181 dgdglappqh lirvegnlyp eyledrqtfr hsvvvpyepp eagseyttih ykymcnsscm
 241 ggmnrrpilt iitledssgn llgrdsfevr vcacpgrdrr teeenfrkke vlcpelppgs
 301 akralptcts asppqkkkpl dgeyftlkir grkrfemfre lnealelkda hateesgdsr
 361 ahsslqpraf qalikeespn c
```

SEQ ID NO: 99 Mouse TP53 transcript variant 2 cDNA sequence (NM_001127233.1; CDS: 158-1303)

```
   1 tttcccctcc cacgtgctca ccctggctaa agttctgtag cttcagttca ttgggaccat
  61 cctggctgta ggtagcgact acagttaggg ggcacctagc attcaggccc tcatcctcct
 121 ccttcccagc agggtgtcac gcttctccga agactggatg actgccatgg aggagtcaca
 181 gtcggatatc agcctcgagc tccctctgag ccaggagaca ttttcaggct tatggaaact
 241 acttcctcca gaagatatcc tgccatcacc tcactgcatg gacgatctgt tgctgcccca
 301 ggatgttgag gagttttttg aaggcccaag tgaagccctc cgagtgtcag gagctcctgc
 361 agcacaggac cctgtcaccg agacccctgg gccagtggcc cctgccccag ccactccatg
 421 gcccctgtca tcttttgtcc cttctcaaaa aacttaccag ggcaactatg gcttccacct
 481 gggcttcctg cagtctggga cagccaagtc tgttatgtgc acgtactctc ctcccctcaa
 541 taagctattc tgccagctgg cgaagacgtg ccctgtgcag ttgtgggtca gcgccacacc
 601 tccagctggg agccgtgtcc gcgccatggc catctacaag aagtcacagc acatgacgga
 661 ggtcgtgaga cgctgccccc accatgagcg ctgctccgat ggtgatggcc tggctcctcc
 721 ccagcatctt atccgggtgg aaggaaattt gtatcccgag tatctggaag acaggcagac
 781 ttttcgccac agcgtggtgg taccttatga gccacccgag gccggctctg agtataccac
 841 catccactac aagtacatgt gtaatagctc ctgcatgggg ggcatgaacc gccgacctat
 901 ccttaccatc atcacactgg aagactccag tgggaacctt ctgggacggg acagctttga
 961 ggttcgtgtt tgtgcctgcc ctgggagaga ccgccgtaca gaagaagaaa atttccgcaa
1021 aaaggaagtc ctttgccctg aactgccccc agggagcgca aagagagcgc tgcccacctg
1081 cacaagcgcc tctcccccgc aaaagaaaaa accacttgat ggagagtatt tcaccctcaa
1141 gatccgcggg cgtaaacgct tcgagatgtt ccgggagctg aatgaggcct tagagttaaa
1201 ggatgcccat gctacagagg agtctggaga cagcagggct cactccagcc tccagcctag
1261 agccttccaa gccttgatca aggaggaaag cccaaactgc tagctcccat cacttcatcc
1321 ctcccctttt ctgtcttcct atagctacct gaagaccaag aagggccagt ctacttcccg
1381 ccataaaaaa acaatggtca agaaagtggg gcctgactca gactgactgc ctctgcatcc
1441 cgtccccatc accagcctcc ccctctcctt gctgtcttat gacttcaggg ctgagacaca
1501 atcctcccgg tcccttctgc tgcctttttt accttgtagc tagggctcag ccccctctct
1561 gagtagtggt tcctggccca agttggggaa taggttgata gttgtcaggt ctctgctggc
1621 ccagcgaaat tctatccagc cagttgttgg accctggcac ctacaatgaa atctcaccct
1681 accccacacc ctgtaagatt ctatcttggg ccctcatagg gtccatatcc tccagggcct
1741 actttccttc cattctgcaa agcctgtctg catttatcca ccccccaccc tgtctccctc
1801 ttttttttt ttttacccct ttttatatat caatttccta ttttacaata aaattttgtt
1861 atcacttaaa aaaaaaa
```

TABLE 1-continued

SEQ ID NO: 100 Mouse TP53 isoform a Amino Acid Sequence (NP_035770.2)
```
  1 mtameesqsd islelplsqe tfsglwkllp pedilpsphc mddlllpqdv eeffegpsea
 61 lrvsgapaaq dpvtetpgpv apapatpwpl ssfvpsqkty qgnygfhlgf lqsgtaksvm
121 ctyspplnkl fcqlaktcpv qlwvsatppa gsrvramaiy kksqhmtevv rrcphhercs
181 dgdglappqh lirvegnlyp eyledrqtfr hsvvvpyepp eagseyttih ykymcnsscm
241 ggmnrrpilt iitledssgn llgrdsfevr vcacpgrdrr teeenfrkke vlcpelppgs
301 akralptcts asppqkkkpl dgeyftlkir grkrfemfre lnealelkda hateesgdsr
361 ahssylktkk gqstsrhkkt mvkkvgpdsd
```

SEQ ID NO: 101 Mouse TP53 transcript variant 1 cDNA sequence (NM_0116403; CDS: 158-1330)
```
   1 tttcccctcc cacgtgctca ccctggctaa agttctgtag cttcagttca ttgggaccat
  61 cctggctgta ggtagcgact acagttaggg ggcacctagc attcaggccc tcatcctcct
 121 ccttcccagc agggtgtcac gcttctccga agactggatg actgccatgg aggagtcaca
 181 gtcggatatc agcctcgagc tccctctgag ccaggagaca ttttcaggct tatggaaact
 241 acttcctcca gaagatatcc tgccatcacc tcactgcatg gacgatctgt tgctgcccca
 301 ggatgttgag gagttttttg aaggcccaag tgaagccctc cgagtgtcag gagctcctgc
 361 agcacaggac cctgtcaccg agacccctgg gccagtggcc cctgccccag ccactccatg
 421 gcccctgtca tcttttgtcc cttctcaaaa aacttaccag ggcaactatg gcttccacct
 481 gggcttcctg cagtctggga cagccaagtc tgttatgtgc acgtactctc ctcccctcaa
 541 taagctattc tgccagctgg cgaagacgtg ccctgtgcag ttgtgggtca gcgccacacc
 601 tccagctggg agccgtgtcc gcgccatggc catctacaag aagtcacagc acatgacgga
 661 ggtcgtgaga cgctgccccc accatgagcg ctgctccgat ggtgatggcc tggctcctcc
 721 ccagcatctt atccgggtgg aaggaaattt gtatcccgag tatctggaag acaggcagac
 781 ttttcgccac agcgtggtgg taccttatga gccacccgag gccggctctg agtataccac
 841 catccactac aagtacatgt gtaatagctc ctgcatgggg ggcatgaacc gccgacctat
 901 ccttaccatc atcacactgg aagactccag tgggaacctt ctgggacggg acagctttga
 961 ggttcgtgtt tgtgcctgcc ctgggagaga ccgccgtaca gaagaagaaa atttccgcaa
1021 aaaggaagtc ctttgccctg aactgccccc agggagcgca aagagagcgc tgcccacctg
1081 cacaagcgcc tctcccccgc aaaagaaaaa accacttgat ggagagtatt tcaccctcaa
1141 gatccgcggg cgtaaacgct tcgagatgtt ccgggagctg aatgaggcct tagagttaaa
1201 ggatgcccat gctacagagg agtctggaga cagcagggct cactccagct acctgaagac
1261 caagaagggc cagtctactt cccgccataa aaaaacaatg gtcaagaaag tggggcctga
1321 ctcagactga ctgcctctgc atcccgtccc catcaccagc ctccccctct ccttgctgtc
1381 ttatgacttc agggctgaga cacaatcctc ccggtccctt ctgctgcctt ttttaccttg
1441 tagctagggc tcagccccct ctctgagtag tggttcctgg cccaagttgg ggaataggtt
1501 gatagttgtc aggtctctgc tggcccagcg aaattctatc cagccagttg ttggaccctg
1561 gcacctacaa tgaaatctca ccctacccca caccctgtaa gattctatct tgggccctca
1621 tagggtccat atcctccagg gcctactttc cttccattct gcaaagcctg tctgcattta
1681 tccacccccc accctgtctc cctctttttt ttttttttac cccttttat atatcaattt
1741 cctattttac aataaaattt tgttatcact taaaaaaaaa a
```

SEQ ID NO: 102 Human TP73 transcript variant 1 cDNA sequence (NM_005427.4; CDS: 160-2070)
```
   1 gccctgcctc cccgcccgcg cacccgcccg gaggctcgcg cgcccgcgaa ggggacgcag
  61 cgaaaccggg gcccgcgcca ggccagccgg gacggacgcc gatgcccggg gctgcgacgg
 121 ctgcagagcg agctgccctc ggaggccggc gtggggaaga tggcccagtc caccgccacc
 181 tcccctgatg gggcaccac gtttgagcac ctctggagct ctctggaacc agacagcacc
 241 tacttcgacc ttccccagtc aagccggggg aataatgagg tggtgggcgg aacggattcc
 301 agcatggacg tcttccacct ggagggcatg actacatctg tcatggccca gttcaatctg
 361 ctgagcagca ccatggacca gatgagcagc cgcgcggcct cggccagccc ctacacccca
 421 gagcacgccg ccagcgtgcc cacccactcg ccctacgcac aacccagctc caccttcgac
 481 accatgtcgc cggcgcctgt catcccctcc aacaccgact accccggacc ccaccacttt
 541 gaggtcactt tccagcagtc cagcacggcc aagtcagcca cctggacgta ctccccgctc
 601 ttgaagaaac tctactgcca gatcgccaag acatgcccca tccagatcaa ggtgtccacc
 661 ccgccacccc caggcaccgc catccgggcc atgcctgttt acaagaaagc ggagcacgtg
 721 accgacgtcg tgaaacgctg ccccaaccac gagctcggga gggacttcaa cgaaggacag
 781 tctgctccag ccagccacct catccgcgtg gaaggcaata atctctcgca gtatgtggat
 841 gaccctgtca ccggcaggca gagcgtcgtg gtgccctatg agccaccaca ggtggggacg
 901 gaattcacca ccatcctgta caacttcatg tgtaacagca gctgtgtagg gggcatgaac
 961 cggcggccca tcctcatcat catcaccctg gagatgcggg atgggcaggt gctgggccgc
1021 cggtcctttg agggccgcat ctgcgcctgt cctggccgcg accgaaaagc tgatgaggac
1081 cactaccggg agcagcaggc cctgaacgag agctccgcca agaacggggc cgccagcaag
1141 cgtgccttca agcagagccc ccctgccgtc cccgcccttg gtgccggtgt gaagaagcgg
1201 cggcatggag acgaggacac gtactacctt caggtgcgag gccgggagaa ctttgagatc
1261 ctgatgaagc tgaaagagag cctggagctg atggagttgg tgccgcagcc actggtggac
1321 tcctatcggc agcagcagca gctcctacag aggccgagtc acctacagcc cccgtcctac
1381 gggccggtcc tctcgcccat gaacaaggtg cacgggggca tgaacaagct gccctccgtc
1441 aaccagctgg tgggccagcc tcccccgcac agttcggcag ctacacccaa cctggggccc
1501 gtgggccccg ggatgctcaa caaccatggc cacgcagtgc cagccaacgg cgagatgagc
1561 agcagccaca gcgcccagtc catggtctcg gggtcccact gcactccgcc acccccctac
1621 cacgccgacc ccagcctcgt cagtttttta acaggattgg ggtgtccaaa ctgcatcgag
1681 tatttcacct cccaagggtt acagagcatt taccacctgc agaacctgac cattgaggac
1741 ctgggggccc tgaagatccc cgagcagtac cgcatgacca tctggcgggg cctgcaggac
1801 ctgaagcagg gccacgacta cagcaccgcg cagcagctgc tccgctctag caacgcggcc
1861 accatctcca tcggcggctc aggggaactg cagcgccagc gggtcatgga ggccgtgcac
1921 ttccgcgtgc gccacaccat caccatcccc aaccgcggcg gcccaggcgg cggccctgac
1981 gagtgggcgg acttcggctt cgacctgccc gactgcaagg cccgcaagca gcccatcaag
2041 gaggagttca cggaggccga gatccactga gggcctcgcc tggctgcagc ctgcgccacc
```

TABLE 1-continued

```
2101 gcccagagac ccaagctgcc tcccctctcc ttcctgtgtg tccaaaactg cctcaggagg
2161 caggaccttc gggctgtgcc cggggaaagg caaggtccgg cccatcccca ggcacctcac
2221 aggccccagg aaaggcccag ccaccgaagc cgcctgtgga cagcctgagt cacctgcaga
2281 accttctgga gctgccctag tgctgggctt gtggggcggg ggctggccca ctctcagccc
2341 tgccactgcc ccggcgtgct ccatggcagg cgtgggtggg gaccgcagcg tcggctccga
2401 cttccaggct tcatcctaga gactgtcatc tcccaaccag gcgaggtcct tccaaaggaa
2461 aggatcctct ttgctgatgg actgccaaaa agtattttgc gacatctttt ggttctggat
2521 agtagtgagc agccaagtga ctgtgtctga aacaccagtg tattttcagg gaatgtccct
2581 aactgcgtct tgcccgcgcc gggggctggg gactctctct gctggacttg ggactggcct
2641 ctgcccccag cacgctgtat tctgcaggac cgcctccttc ctgcccctaa caacaaccac
2701 agtgttgctg aaattggaga aaactgggga gggcgcaacc ccccccaggc gcggggaagc
2761 atgtggtacc gcctcagcca gtgcccctca gcctggccac agtcgcctct cctcggggac
2821 ccctcagcag aaagggacag cctgtcctta gaggactgga aattgtcaat atttgataaa
2881 atgataccct tttctacatg gtgggtcagc tttttttttt ttttttttaa ctttctttct
2941 cagcattctc tttggagttc aacctagcgc ccatgagcca ggctgaggaa gctgagtgag
3001 aagccaggtg ggcgggactt gttcccagga aggccgggtg gggaggaagc ctagagggaa
3061 ccccaggaag ggcaaatcca ggcaaatctg caggaatgct ctgccatggg agcagctcct
3121 cccttgccac ggccaccttc tctagcactg caaggtccac agggcattgc tttcctttct
3181 aggcggtggc agtcagggaa cagactgagg taggtgtagg ggggtctagg ccttcgtgga
3241 gcaccccagg gagttagtag gccccgggga gacagagtct gcacaggccc tttctggggc
3301 cacctccatc cacgaggagc agcctgagcc ttggtggccg aaccttgacc gtcccggagc
3361 acagcttcag ggcagggaac cggagcccct ggggggcctc acgggtgtga cgaggccctt
3421 cattgcaggc aggtgggcca atgggagccc tcacccacgc aagccgagac accacccaga
3481 gtgcaggctg cctggcccct tctggcacgg ccagctccac accccctgcc tagggtatgt
3541 gtggtcctaa gggctaggag cttcccctac taacatctcc cagaaaaagc agttaagccc
3601 ctcagggcac agcaaggtta gacacagccc ccatccccag atcaggactc catcttgcta
3661 agtggcatca ccgtcaccag cctcccctta tttaaaagca gcgactggtg ttgccgcagg
3721 tacctggtct acgaagacgc aggcatccct ctcccaccgt ccacctcccc gggggccgct
3781 gacagcacag tcgcctgggt gcacgcttgt gggggcagca ggaacggggc tgtcggctct
3841 caggggatct ggctgcagcc agggcgaggg cctggccctt ccttccagct ccttccggct
3901 ccttccagct gaagggcagg aagctctggc cgcttagctt ctagggttcc atctccctag
3961 aaaggtgccc acgcccaggg catcagtcag tagcggcagc agcagcagac tcggggcttt
4021 cccagggtgg cgcagccacc ccagctgcat gtcacctcag ctctccatct tattgccatt
4081 ttgtagatga ggaagctgag accagaaagg ctaagaccca tgccccaggc accacaccca
4141 tctcttgggg gctgggcacc tgctacccga ggccacctcc tgaagccccc actcttcccc
4201 catgttccac ttcaggagcc gcgggggccc atcctgacac ccggggttcc tcagcccagc
4261 gcagatgtgc ttcagttcca gagggcttgt tgatttgttt cttaggtacg ttacctgtcc
4321 accctgagtc cagtgaggct gtcccaagag cccctgtagt gtgctcctgg gaagggctgg
4381 gggggctggg ggggctggga gaggcccagg ggcagctgtc actggaaccc cagccagatg
4441 tccaaggaag ccggccagaa cacggagcag ccagatggcc ccagctgcac ctgtctaggg
4501 agcccatgca gcctccttgc actggagaag cagctgtgaa agtagacaga gttgagactt
4561 cgccgtggtc aggagaaaat gcaaattccc aggaacaaga atcctttaag tgatatgttt
4621 ttataaaact aaacaaatca acaaataaat cttgaaggcg gatggttttc ccagcagtgc
4681 aggggttgga gggaggctgc tggcactcct ggggccaagg gggacaggca gtggtcctga
4741 gtctgctcag agaggcaagg cagaaggagc tcgccaggca ggtcagctca catctgtcca
4801 agtcgctctg gtcagaaaca gcgactctcc cccattcccc cagcgttccc accaggcctg
4861 ggctgctggg aagcccttgc tgtacccagg agcccgaccc gcagtatcct ggcacagagc
4921 cacttgtcac tcagaacagt cagtgtctcc aacgcacaaa catccactcc tctgttacca
4981 gttaaagcac tttaatgctt taaggtgaaa acgaaatccc atccgtgttt ttcgtgtaag
5041 atcgtgcttc tccgagcagt attaatggac gccctccaat gacataacaa ctgtttttgg
5101 taatgtaatc ttgggaaaat gtgttatttt tttagctgtg tttcagtggg gatttttgtt
5161 tttgtaacat aataaagtgt atgttccaat ga
```

SEQ ID NO: 103 Human TP73 isoform 1 amino acid sequence (NP_005418.1)

```
  1 maqstatspd ggttfehlws slepdstyfd lpqssrgnne vvggtdssmd vfhlegmtts
 61 vmaqfnllss tmdqmssraa saspytpeha asvpthspya qpsstfdtms papvipsntd
121 ypgphhfevt fqqsstaksa twtyspllkk lycqiaktcp iqikvstppp pgtairampv
181 ykkaehvtdv vkrcpnhelg rdfnegqsap ashlirvegn nlsqyvddpv tgrqsvvvpy
241 eppqvgteft tilynfmcns scvggmnrrp iliiitlemr dgqvlgrrsf egricacpgr
301 drkadedhyr eqqalnessa kngaaskraf kqsppavpal gagvkkrrhg dedtyylqvr
361 grenfeilmk lkeslelmel vpqplvdsyr qqqqllqrps hlqppsygpv lspmnkvhgg
421 mnklpsvnql vgqpppthssa atpnlgpvgp gmlnnhghav pangemsssh saqsmvsgsh
481 ctppppyhad pslvsfltgl gcpncieyft sqglqsiyhl qnltiedlga lkipeqyrmt
541 iwrglqdlkq ghdystaqql lrssnaatis iggsgelqrq rvmeavhfrv rhtitipnrg
601 gpgggpdewa dfgfdlpdck arkqpikeef teaeih
```

SEQ ID NO: 104 Human TP73 transcript variant 2 cDNA sequence (NM_001126240.3; CDS: 235-1998)

```
  1 ggattcagcc agttgacaga actaagggag atgggaaaag cgaaaatgcc aacaaacggc
 61 ccgcatgttc cccagcatcc tcggctcctg cctcactagc tgcggagcct ctcccgctcg
121 gtccacgctg ccgggcggcc acgaccgtga cccttcccct cgggccgccc agatccatgc
181 ctcgtcccac gggacaccag ttccctggcg tgtgcagacc ccccggcgcc taccatgctg
241 tacgtcggtg accccgcacg gcacctcgcc acggcccagt tcaatctgct gagcagcacc
301 atggaccaga tgagcagccg cgcggcctcg gccagcccct acaccccaga gcacgccgcc
361 agcgtgccca cccactcgcc ctacgcacaa cccagctcca ccttcgacac catgtcgccg
421 gcgcctgtca tcccctccaa caccgactac cccggacccc accactttga ggtcactttc
481 cagcagtcca gcacggccaa gtcagccacc tggacgtact ccccgctctt gaagaaactc
541 tactgccaga tcgccaagac atgccccatc cagatcaagg tgtccacccc gccacccccca
601 ggcaccgcca tccgggccat gcctgtttac aagaaagcgg agcacgtgac cgacgtcgtg
661 aaacgctgcc ccaaccacga gctcgggagg gacttcaacg aaggacagtc tgctccagcc
```

TABLE 1-continued

```
 721 agccacctca tccgcgtgga aggcaataat ctctcgcagt atgtggatga ccctgtcacc
 781 ggcaggcaga gcgtcgtggt gccctatgag ccaccacagg tggggacgga attcaccacc
 841 atcctgtaca acttcatgtg taacagcagc tgtgtagggg gcatgaaccg gcggcccatc
 901 ctcatcatca tcaccctgga gatgcgggat gggcaggtgc tgggccgccg gtcctttgag
 961 ggccgcatct gcgcctgtcc tggccgcgac cgaaaagctg atgaggacca ctaccgggag
1021 cagcaggccc tgaacgagag ctccgccaag aacggggccg ccagcaagcg tgccttcaag
1081 cagagccccc ctgccgtccc cgcccttggt gccggtgtga agaagcggcg gcatggagac
1141 gaggacacgt actaccttca ggtgcgaggc cgggagaact ttgagatcct gatgaagctg
1201 aaagagagcc tggagctgat ggagttggtg ccgcagccac tggtggactc ctatcggcag
1261 cagcagcagc tcctacagag gccgagtcac ctacagcccc cgtcctacgg gccggtcctc
1321 tcgcccatga acaaggtgca cgggggcatg aacaagctgc cctccgtcaa ccagctggtg
1381 ggccagcctc ccccgcacag ttcggcagct acacccaacc tggggcccgt gggccccggg
1441 atgctcaaca accatggcca cgcagtgcca gccaacggcg agatgagcag cagccacagc
1501 gcccagtcca tggtctcggg gtcccactgc actccgccac ccccctacca cgccgacccc
1561 agcctcgtca gtttttttaac aggattgggg tgtccaaact gcatcgagta tttcacctcc
1621 caagggttac agagcattta ccacctgcag aacctgacca ttgaggacct gggggccctg
1681 aagatccccg agcagtaccg catgaccatc tggcggggcc tgcaggacct gaagcagggc
1741 cacgactaca gcaccgcgca gcagctgctc cgctctagca acgcggccac catctccatc
1801 ggcggctcag ggggaactgca gcgccagcgg gtcatggagg ccgtgcactt ccgcgtgcgc
1861 cacaccatca ccatccccaa ccgcggcggc ccaggcggcg gccctgacga gtgggcggac
1921 ttcggcttcg acctgcccga ctgcaaggcc cgcaagcagc ccatcaagga ggagttcacg
1981 gaggccgaga tccactgagg gcctcgcctg gctgcagcct gcgccaccgc ccagagaccc
2041 aagctgcctc ccctctcctt cctgtgtgtc caaaactgcc tcaggaggca ggaccttcgg
2101 gctgtgcccg gggaaaggca aggtccggcc catccccagg cacctcacag gccccaggaa
2161 aggcccagcc accgaagccg cctgtggaca gcctgagtca cctgcagaac cttctggagc
2221 tgccctagtg ctgggcttgt ggggcggggg ctggcccact ctcagccctg ccactgcccc
2281 ggcgtgctcc atggcaggcg tgggtgggga ccgcagcgtc ggctccgact tccaggcttc
2341 atcctagaga ctgtcatctc ccaaccaggc gaggtccttc caaaggaaag gatcctcttt
2401 gctgatggac tgccaaaaag tattttgcga catcttttgg ttctggatag tagtgagcag
2461 ccaagtgact gtgtctgaaa caccagtgta ttttcaggga atgtccctaa ctgcgtcttg
2521 cccgcgccgg gggctgggga ctctctctgc tggacttggg actggcctct gcccccagca
2581 cgctgtattc tgcaggaccg cctccttcct gcccctaaca acaaccacag tgttgctgaa
2641 attggagaaa actggggagg gcgcaacccc ccccaggcgc ggggaagcat gtggtaccgc
2701 ctcagccagt gcccctcagc ctggccacag tcgcctctcc tcggggaccc ctcagcagaa
2761 agggacagcc tgtccttaga ggactggaaa ttgtcaatat ttgataaaat gataccctttt
2821 tctacatggt gggtcagctt ttttttttttt tttttttaact ttctttctca gcattctctt
2881 tggagttcaa cctagcgccc atgagccagg ctgaggaagc tgagtgagaa gccaggtggg
2941 cgggacttgt tcccaggaag gccgggtggg gaggaagcct agagggaacc ccaggaaggg
3001 caaatccagg caaatctgca ggaatgctct gccatgggag cagctcctcc cttgccacgg
3061 ccaccttctc tagcactgca aggtccacag ggcattgctt tcctttctag gcggtggcag
3121 tcagggaaca gactgaggta ggtgtagggg ggtctaggcc ttcgtggagc accccaggga
3181 gttagtaggc cccggggaga cagagtctgc acaggccctt tctggggcca cctccatcca
3241 cgaggagcag cctgagcctt ggtggccgaa ccttgaccgt cccggagcac agcttcaggg
3301 cagggaaccg gagcccctgg ggggcctcac gggtgtgacg aggcccttca ttgcaggcag
3361 gtgggccaat gggagccctc acccacgcaa gccgagacac cacccagagt gcaggctgcc
3421 tggccccttc tggcacggcc agctccacac cccctgccta gggtatgtgt ggtcctaagg
3481 gctaggagct tcccctacta acatctccca gaaaaagcag ttaagcccct cagggcacag
3541 caaggttaga cacagccccc atccccagat caggactcca tcttgctaag tggcatcacc
3601 gtcaccagcc tcccctattt taaaagcagc gactggtgtt gccgcaggta cctggtctac
3661 gaagacgcag gcatccctct cccaccgtcc acctccccgg gggccgctga cagcacagtc
3721 gcctgggtgc acgcttgtgg gggcagcagg aacggggctg tcggctctca ggggatctgg
3781 ctgcagccag ggcgagggcc tggcccttcc ttccagctcc ttccggctcc ttccagctga
3841 agggcaggaa gctctggccg cttagcttct agggttccat ctccctagaa aggtgcccac
3901 gcccagggca tcagtcagta gcggcagcag cagcagactc ggggctttcc cagggtggcg
3961 cagccacccc agctgcatgt cacctcagct ctccatctta ttgccatttt gtagatgagg
4021 aagctgagac cagaaaggct aagacccatg ccccaggcac cacacccatc tcttgggggc
4081 tgggcacctg ctacccgagg ccacctcctg aagcccccac tcttccccca tgttccactt
4141 caggagccgc gggggcccat cctgacaccc ggggttcctc agcccagcgc agatgtgctt
4201 cagttccaga gggcttgttg atttgtttct taggtacgtt acctgtccac cctgagtcca
4261 gtgaggctgt cccaagagcc cctgtagtgt gctcctggga agggctgggg gggctggggg
4321 ggctgggaga ggcccagggg cagctgtcac tggaacccca gccagatgtc caaggaagcc
4381 ggccagaaca cggagcagcc agatggcccc agctgcacct gtctagggag cccatgcagc
4441 ctccttgcac tggagaagca gctgtgaaag tagacagagt tgagacttcg ccgtggtcag
4501 gagaaaatgc aaattcccag gaacaagaat cctttaagtg atatgttttt ataaaactaa
4561 acaaatcaac aaataaatct tgaaggcgga tggttttccc agcagtgcag gggttggagg
4621 gaggctgctg gcactcctgg ggccaagggg gacaggcagt ggtcctgagt ctgctcagag
4681 aggcaaggca gaaggagctc gccaggcagg tcagctcaca tctgtccaag tcgctctggt
4741 cagaaacagc gactctcccc cattccccca gcgttcccac caggcctggg ctgctgggaa
4801 gcccttgctg tacccaggag cccgacccgc agtatcctgg cacagagcca cttgtcactc
4861 agaacagtca gtgtctccaa cgcacaaaca tccactcctc tgttaccagt taaagcactt
4921 taatgcttta aggtgaaaac gaaatcccat ccgtgttttt cgtgtaagat cgtgcttctc
4981 cgagcagtat taatggacgc cctccaatga cataacaact gtttttggta atgtaatctt
5041 gggaaaatgt gttatttttt tagctgtgtt tcagtgggga tttttgtttt tgtaacataa
5101 taaagtgtat gttccaatga
```

SEQ ID NO: 105 Human TP73 isoform 2 amino acid sequence (NP_001119712.1)

```
  1 mlyvgdparh lataqfnils stmdqmssra asaspytpeh aasvpthspy aqpsstfdtm
 61 spapvipsnt dypgphhfev tfqqsstaks atwtyspllk klycqiaktc piqikvstpp
121 ppgtairamp vykkaehvtd vvkrcpnhel grdfnegqsa pashlirveg nnlsqyvddp
181 vtgrqsvvvp yeppqvgtef ttilynfmcn sscvggmnrr piliiitlem rdgqvlgrrs
```

TABLE 1-continued

```
 241 fegricacpg rdrkadedhy reqqalness akngaaskra fkqsppavpa lgagvkkrrh
 301 gdedtyylqv rgrenfeilm klkeslelme lvpqplvdsy rqqqllqrp shlqppsygp
 361 vlspmnkvhg gmnklpsvnq lvgqppphss aatpnlgpvg pgmlnnhgha vpangemsss
 421 hsaqsmvsgs hctppppyha dpslvsfltg lgcpncieyf tsqglqsiyh lqnitiedlg
 481 alkipeqyrm tiwrglqdlk qghdystaqq llrssnaati siggsgelqr qrvmeavhfr
 541 vrhtitipnr ggpgggpdew adfgfdlpdc karkqpikee fteaeih
```

SEQ ID NO: 106 Human TP73 transcript variant 3 cDNA sequence
(NM_001126241.3; CDS: 235-1587)

```
   1 ggattcagcc agttgacaga actaagggag atgggaaaag cgaaaatgcc aacaaacggc
  61 ccgcatgttc cccagcatcc tcggctcctg cctcactagc tgcggagcct ctcccgctcg
 121 gtccacgctg ccgggcggcc acgaccgtga cccttcccct cgggccgccc agatccatgc
 181 ctcgtcccac gggacaccag ttccctggcg tgtgcagacc ccccggcgcc taccatgctg
 241 tacgtcggtg accccgcacg gcacctcgcc acggcccagt tcaatctgct gagcagcacc
 301 atggaccaga tgagcagccg cgcggcctcg gccagcccct acaccccaga gcacgccgcc
 361 agcgtgccca cccactcgcc ctacgcacaa cccagctcca ccttcgacac catgtcgccg
 421 gcgcctgtca tcccctccaa caccgactac cccggacccc accactttga ggtcactttc
 481 cagcagtcca gcacggccaa gtcagccacc tggacgtact ccccgctctt gaagaaactc
 541 tactgccaga tcgccaagac atgccccatc cagatcaagg tgtccacccc gccaccccca
 601 ggcaccgcca tccgggccat gcctgtttac aagaaagcgg agcacgtgac cgacgtcgtg
 661 aaacgctgcc ccaaccacga gctcgggagg gacttcaacg aaggacagtc tgctccagcc
 721 agccacctca tccgcgtgga aggcaataat ctctcgcagt atgtggatga ccctgtcacc
 781 ggcaggcaga gcgtcgtggt gccctatgag ccaccacagg tggggacgga attcaccacc
 841 atcctgtaca acttcatgtg taacagcagc tgtgtagggg gcatgaaccg gcggcccatc
 901 ctcatcatca tcaccctgga gatgcgggat gggcaggtgc tgggccgccg gtcctttgag
 961 ggccgcatct gcgcctgtcc tggccgcgac cgaaaagctg atgaggacca ctaccgggag
1021 cagcaggccc tgaacgagag ctccgccaag aacggggccg ccagcaagcg tgccttcaag
1081 cagagccccc ctgccgtccc cgcccttggt gccggtgtga agaagcggcg gcatggagac
1141 gaggacacgt actaccttca ggtgcgaggc cgggagaact ttgagatcct gatgaagctg
1201 aaagagagcc tggagctgat ggagttggtg ccgcagccac tggtggactc ctatcggcag
1261 cagcagcagc tcctacagag gccgagtcac ctacagcccc cgtcctacgg gccggtcctc
1321 tcgcccatga acaaggtgca cgggggcatg aacaagctgc cctccgtcaa ccagctggtg
1381 ggccagcctc cccgcacag ttcggcagct acacccaacc tggggcccgt gggccccggg
1441 atgctcaaca accatggcca cgcagtgcca gccaacggcg agatgagcag cagccacagc
1501 gcccagtcca tggtctcggg gtcccactgc actccgccac cccctacca cgccgacccc
1561 agcctcgtca ggacctgggg gccctgaaga tccccgagca gtaccgcatg accatctggc
1621 ggggcctgca ggacctgaag cagggccacg actacagcac cgcgcagcag ctgctccgct
1681 ctagcaacgc ggccaccatc tccatcggcg gctcagggga actgcagcgc cagcgggtca
1741 tggaggccgt gcacttccgc gtgcgccaca ccatcaccat ccccaaccgc ggcggcccag
1801 gcggcggccc tgacgagtgg gcggacttcg gcttcgacct gcccgactgc aaggcccgca
1861 agcagcccat caaggaggag ttcacggagg ccgagatcca ctgagggcct cgcctggctg
1921 cagcctgcgc caccgcccag agacccaagc tgcctcccct ctccttcctg tgtgtccaaa
1981 actgcctcag gaggcaggac cttcgggctg tgcccgggga aaggcaaggt ccggcccatc
2041 cccaggcacc tcacaggccc caggaaaggc ccagccaccg aagccgcctg tggacagcct
2101 gagtcacctg cagaaccttc tggagctgcc ctagtgctgg gcttgtgggg cgggggctgg
2161 cccactctca gccctgccac tgccccggcg tgctccatgg caggcgtggg tggggaccgc
2221 agcgtcggct ccgacttcca ggcttcatcc tagagactgt catctcccaa ccaggcgagg
2281 tccttccaaa ggaaaggatc ctctttgctg atggactgcc aaaaagtatt ttgcgacatc
2341 ttttggttct ggatagtagt gagcagccaa gtgactgtgt ctgaaacacc agtgtatttt
2401 cagggaatgt ccctaactgc gtcttgcccg cgccgggggc tggggactct ctctgctgga
2461 cttgggactg gcctctgccc ccagcacgct gtattctgca ggaccgcctc cttcctgccc
2521 ctaacaacaa ccacagtgtt gctgaaattg gagaaaactg gggagggcgc aacccccccc
2581 aggcgcgggg aagcatgtgg taccgcctca gccagtgccc ctcagcctgg ccacagtcgc
2641 ctctcctcgg ggacccctca gcagaaaggg acagcctgtc cttagaggac tggaaattgt
2701 caatatttga taaaatgata cccttttcta catggtgggt cagctttttt tttttttttt
2761 ttaactttct ttctcagcat tctctttgga gttcaaccta gcgcccatga gccaggctga
2821 ggaagctgag tgagaagcca ggtgggcggg acttgttccc aggaaggccg ggtggggagg
2881 aagcctagag ggaaccccag gaagggcaaa tccaggcaaa tctgcaggaa tgctctgcca
2941 tgggagcagc tcctcccttg ccacggccac cttctctagc actgcaaggt ccacagggca
3001 ttgctttcct ttctaggcgg tggcagtcag ggaacagact gaggtaggtg tagggggtc
3061 taggccttcg tggagcaccc cagggagtta gtaggccccg gggagacaga gtctgcacag
3121 gccctttctg ggccacctc catccacgag gagcagcctg agccttggtg gccgaacctt
3181 gaccgtcccg gagcacagct tcagggcagg gaaccggagc ccctgggggg cctcacgggt
3241 gtgacgaggc ccttcattgc aggcaggtgg gccaatggga gccctcaccc acgcaagccg
3301 agacaccacc cagagtgcag gctgcctggc cccttctggc acggccagct ccacacccc
3361 tgcctagggt atgtgtggtc ctaagggcta ggagcttccc ctactaacat ctcccagaaa
3421 aagcagttaa gcccctcagg gcacagcaag gttagacaca gcccccatcc ccagatcagg
3481 actccatctt gctaagtggc atcaccgtca ccagcctccc cttatttaaa agcagcgact
3541 ggtgttgccg caggtacctg gtctacgaag acgcaggcat ccctctccca ccgtccacct
3601 ccccgggggc cgctgacagc acagtcgcct gggtgcacgc ttgtgggggc agcaggaacg
3661 gggctgtcgg ctctcagggg atctggctgc agccagggcg agggcctggc ccttccttcc
3721 agctccttcc ggctccttcc agctgaaggg caggaagctc tggccgctta gcttctaggg
3781 ttccatctcc ctagaaaggt gcccacgccc agggcatcag tcagtagcgg cagcagcagc
3841 agactcgggg ctttcccagg gtggcgcagc caccccagct gcatgtcacc tcagctctcc
3901 atcttattgc cattttgtag atgaggaagc tgagaccaga aaggctaaga cccatgcccc
3961 aggcaccaca cccatctctt gggggctggg cacctgctac ccgaggccac ctcctgaagc
4021 ccccactctt cccccatgtt ccacttcagg agccgcgggg gcccatcctg acacccgggg
4081 ttcctcagcc cagcgcagat gtgcttcagt tccagagggc ttgttgattt gtttcttagg
4141 tacgttacct gtccaccctg agtccagtga ggctgtccca agagcccctg tagtgtgctc
4201 ctgggaaggg ctgggggggc tggggggct gggagaggcc caggggcagc tgtcactgga
```

TABLE 1-continued

```
4261 accccagcca gatgtccaag gaagccggcc agaacacgga gcagccagat ggccccagct
4321 gcacctgtct agggagccca tgcagcctcc ttgcactgga gaagcagctg tgaaagtaga
4381 cagagttgag acttcgccgt ggtcaggaga aaatgcaaat tcccaggaac aagaatcctt
4441 taagtgatat gtttttataa aactaaacaa atcaacaaat aaatcttgaa ggcggatggt
4501 tttcccagca gtgcaggggt tggagggagg ctgctggcac tcctggggcc aagggggaca
4561 ggcagtggtc ctgagtctgc tcagagaggc aaggcagaag gagctcgcca ggcaggtcag
4621 ctcacatctg tccaagtcgc tctggtcaga aacagcgact ctcccccatt cccccagcgt
4681 tcccaccagg cctgggctgc tgggaagccc ttgctgtacc caggagcccg acccgcagta
4741 tcctggcaca gagccacttg tcactcagaa cagtcagtgt ctccaacgca caaacatcca
4801 ctcctctgtt accagttaaa gcactttaat gctttaaggt gaaaacgaaa tcccatccgt
4861 gtttttcgtg taagatcgtg cttctccgag cagtattaat ggacgccctc caatgacata
4921 acaactgttt ttggtaatgt aatcttggga aaatgtgtta ttttttagc tgtgtttcag
4981 tggggatttt tgtttttgta acataataaa gtgtatgttc caatga
```

SEQ ID NO: 107 Human TP73 isoform 3 amino acid sequence (NP_001119713.1)

```
1   mlyvgdparh lataqfnlls stmdqmssra asaspytpeh aasvpthspy aqpsstfdtm
61  spapvipsnt dypgphhfev tfqqsstaks atwtyspllk klycqiaktc piqikvstpp
121 ppgtairamp vykkaehvtd vvkrcpnhel grdfnegqsa pashlirveg nnlsqyvddp
181 vtgrqsvvvp yeppqvgtef ttilynfmcn sscvggmnrr piliiitlem rdgqvlgrrs
241 fegricacpg rdrkadedhy reqqalness akngaaskra fkqsppavpa lgagvkkrrh
301 gdedtyylqv rgrenfeilm klkeslelme lvpqplvdsy rqqqqllqrp shlqppsygp
361 vlspmnkvhg gmnklpsvnq lvgqpppphss aatpnlgpvg pgmlnnhgha vpangemsss
421 hsaqsmvsgs hctppppyha dpslvrtwgp
```

SEQ ID NO: 108 Human TP73 transcript variant 4 cDNA sequence (NM_001126242.3; CDS: 235-1515)

```
   1 ggattcagcc agttgacaga actaagggag atgggaaaag cgaaaatgcc aacaaacggc
  61 ccgcatgttc cccagcatcc tcggctcctg cctcactagc tgcggagcct ctcccgctcg
 121 gtccacgctg ccgggcggcc acgaccgtga cccttcccct cgggccgccc agatccatgc
 181 ctcgtcccac gggacaccag ttccctggcg tgtgcagacc ccccggcgcc taccatgctg
 241 tacgtcggtg accccgcacg gcacctcgcc acggcccagt tcaatctgct gagcagcacc
 301 atggaccaga tgagcagccg cgcggcctcg gccagcccct acaccccaga gcacgccgcc
 361 agcgtgccca cccactcgcc ctacgcacaa cccagctcca ccttcgacac catgtcgccg
 421 gcgcctgtca tccccctccaa caccgactac cccggacccc accactttga ggtcactttc
 481 cagcagtcca gcacggccaa gtcagccacc tggacgtact ccccgctctt gaagaaactc
 541 tactgccaga tcgccaagac atgccccatc cagatcaagg tgtccacccc gccaccccca
 601 ggcaccgcca tccgggccat gcctgtttac aagaaagcgg agcacgtgac cgacgtcgtg
 661 aaacgctgcc ccaaccacga gctcgggagg gacttcaacg aaggacagtc tgctccagcc
 721 agccacctca tccgcgtgga aggcaataat ctctcgcagt atgtggatga ccctgtcacc
 781 ggcaggcaga gcgtcgtggt gccctatgag ccaccacagg tggggacgga attcaccacc
 841 atcctgtaca acttcatgtg taacagcagc tgtgtagggg gcatgaaccg gcggcccatc
 901 ctcatcatca tcaccctgga gatgcgggat gggcaggtgc tgggccgccg gtcctttgag
 961 ggccgcatct gcgcctgtcc tggccgcgac cgaaaagctg atgaggacca ctaccgggag
1021 cagcaggccc tgaacgagag ctccgccaag aacggggccg ccagcaagcg tgccttcaag
1081 cagagccccc ctgccgtccc cgcccttggt gccggtgtga agaagcggcg gcatggagac
1141 gaggacacgt actaccttca ggtgcgaggc cgggagaact ttgagatcct gatgaagctg
1201 aaagagagcc tggagctgat ggagttggtg ccgcagccac tggtggactc ctatcggcag
1261 cagcagcagc tcctacagag gccgccccgg gatgctcaac aaccatggcc acgcagtgcc
1321 agccaacggc gagatgagca gcagccacag cgcccagtcc atggtctcgg ggtcccactg
1381 cactccgcca cccccctacc acgccgaccc cagcctcgtc agttttttaa caggattggg
1441 gtgtccaaac tgcatcgagt atttcacctc ccaagggtta cagagcattt accacctgca
1501 gaacctgacc attgaggacc tgggggccct gaagatcccc gagcagtacc gcatgaccat
1561 ctggcggggc ctgcaggacc tgaagcaggg ccacgactac agcaccgcgc agcagctgct
1621 ccgctctagc aacgcggcca ccatctccat cggcggctca ggggaactgc agcgccagcg
1681 ggtcatggag gccgtgcact tccgcgtgcg ccacaccatc accatcccca accgcggcgg
1741 cccaggcggc ggccctgacg agtgggcgga cttcggcttc gacctgcccg actgcaaggc
1801 ccgcaagcag cccatcaagg aggagttcac ggaggccgag atccactgag ggcctcgcct
1861 ggctgcagcc tgcgccaccg cccagagacc caagctgcct cccctctcct tcctgtgtgt
1921 ccaaaactgc ctcaggaggc aggaccttcg ggctgtgccc ggggaaaggc aaggtccggc
1981 ccatccccag gcacctcaca ggccccagga aaggcccagc caccgaagcc gcctgtggac
2041 agcctgagtc acctgcagaa ccttctggag ctgccctagt gctgggcttg tggggcgggg
2101 gctggcccac tctcagccct gccactgccc cggcgtgctc catggcaggc gtgggtgggg
2161 accgcagcgt cggctccgac ttccaggctt catcctagag actgtcatct cccaaccagg
2221 cgaggtcctt ccaaaggaaa ggatcctctt tgctgatgga ctgccaaaaa gtattttgcg
2281 acatcttttg gttctggata gtagtgagca gccaagtgac tgtgtctgaa acaccagtgt
2341 attttcaggg aatgtcccta actgcgtctt gcccgcgccg ggggctgggg actctctctg
2401 ctggacttgg gactggcctc tgcccccagc acgctgtatt ctgcaggacc gcctccttcc
2461 tgcccctaac aacaaccaca gtgttgctga aattggagaa aactggggag ggcgcaaccc
2521 cccccaggcg cggggaagca tgtggtaccg cctcagccag tgcccctcag cctggccaca
2581 gtcgcctctc ctcggggacc cctcagcaga aagggacagc ctgtccttag aggactggaa
2641 attgtcaata tttgataaaa tgataccctt ttctacatgg tgggtcagct tttttttttt
2701 ttttttaac tttctttctc agcattctct ttggagttca acctagcgcc catgagccag
2761 gctgaggaag ctgagtgaga agccaggtgg gcgggacttg ttcccaggaa ggccgggtgg
2821 ggaggaagcc tagagggaac cccaggaagg gcaaatccag gcaaatctgc aggaatgctc
2881 tgccatggga gcagctcctc ccttgccacg gccaccttct ctagcactgc aaggtccaca
2941 gggcattgct ttcctttcta ggcggtggca gtcagggaac agactgaggt aggtgtaggg
3001 gggtctaggc cttcgtggag caccccaggg agttagtagg ccccggggag acagagtctg
3061 cacaggccct ttctggggcc acctccatcc acgaggagca gcctgagcct tggtggccga
3121 accttgaccg tcccggagca cagcttcagg gcagggaacc ggagcccctg gggggcctca
3181 cgggtgtgac gaggcccttc attgcaggca ggtgggccaa tgggagccct cacccacgca
```

TABLE 1-continued 3241 agccgagaca ccacccagag tgcaggctgc ctggcccctt ctggcacggc cagctccaca
3301 ccccctgcct agggtatgtg tggtcctaag ggctaggagc ttcccctact aacatctccc
3361 agaaaaagca gttaagcccc tcagggcaca gcaaggttag acacagcccc catccccaga
3421 tcaggactcc atcttgctaa gtggcatcac cgtcaccagc ctccccttat ttaaaagcag
3481 cgactggtgt tgccgcaggt acctggtcta cgaagacgca ggcatccctc tcccaccgtc
3541 cacctccccg ggggccgctg acagcacagt cgcctgggtg cacgcttgtg ggggcagcag
3601 gaacggggct gtcggctctc aggggatctg gctgcagcca gggcgagggc ctggcccttc
3661 cttccagctc cttccggctc cttccagctg aagggcagga agctctggcc gcttagcttc
3721 tagggttcca tctccctaga aaggtgccca cgcccagggc atcagtcagt agcggcagca
3781 gcagcagact cggggctttc ccagggtggc gcagccaccc cagctgcatg tcacctcagc
3841 tctccatctt attgccattt tgtagatgag gaagctgaga ccagaaaggc taagacccat
3901 gccccaggca ccacacccat ctcttggggg ctgggcacct gctacccgag gccacctcct
3961 gaagccccca ctcttccccc atgttccact tcaggagccg cgggggccca tcctgacacc
4021 cggggttcct cagcccagcg cagatgtgct tcagttccag agggcttgtt gatttgtttc
4081 ttaggtacgt tacctgtcca ccctgagtcc agtgaggctg tcccaagagc ccctgtagtg
4141 tgctcctggg aagggctggg ggggctgggg gggctgggag aggcccaggg gcagctgtca
4201 ctggaacccc agccagatgt ccaaggaagc cggccagaac acggagcagc cagatggccc
4261 cagctgcacc tgtctaggga gcccatgcag cctccttgca ctggagaagc agctgtgaaa
4321 gtagacagag ttgagacttc gccgtggtca ggagaaaatg caaattccca ggaacaagaa
4381 tcctttaagt gatatgtttt tataaaacta aacaaatcaa caaataaatc ttgaaggcgg
4441 atggttttcc cagcagtgca ggggttggag ggaggctgct ggcactcctg gggccaaggg
4501 ggacaggcag tggtcctgag tctgctcaga gaggcaaggc agaaggagct cgccaggcag
4561 gtcagctcac atctgtccaa gtcgctctgg tcagaaacag cgactctccc ccattccccc
4621 agcgttccca ccaggcctgg gctgctggga agcccttgct gtacccagga gcccgacccg
4681 cagtatcctg gcacagagcc acttgtcact cagaacagtc agtgtctcca acgcacaaac
4741 atccactcct ctgttaccag ttaaagcact ttaatgcttt aaggtgaaaa cgaaatccca
4801 tccgtgtttt tcgtgtaaga tcgtgcttct ccgagcagta ttaatggacg ccctccaatg
4861 acataacaac tgtttttggt aatgtaatct tgggaaaatg tgttattttt ttagctgtgt
4921 ttcagtgggg atttttgttt ttgtaacata ataaagtgta tgttccaatg a SEQ ID NO: 109 Human TP73 isoform 4 amino acid sequence (NP_001119714.1)
1 mlyvgdparh lataqfnlls stmdqmssra asaspytpeh aasvpthspy aqpsstfdtm
61 spapvipsnt dypgphhfev tfqqsstaks atwtyspllk klycqiaktc piqikvstpp
121 ppgtairamp vykkaehvtd vvkrcpnhel grdfnegqsa pashlirveg nnlsqyvddp
181 vtgrqsvvvp yeppqvgtef ttilynfmcn sscvggmnrr piliiitlem rdgqvlgrrs
241 fegricacpg rdrkadedhy reqqalness akngaaskra fkqsppavpa lgagvkkrrh
301 gdedtyylqv rgrenfeilm klkesleime ivpqpivdsy rqqqllqrp prdaqqpwpr
361 sasqrrdeqq pqrpvhglgv plhsatplpr rpqprqffnr igvsklhrvf hlprvtehlp
421 paepdh SEQ ID NO: 110 Human TP73 transcript variant 5 cDNA sequence
(NM_001204189.2; CDS: 235-1299)
1 ggattcagcc agttgacaga actaagggag atgggaaaag cgaaaatgcc aacaaacggc
61 ccgcatgttc cccagcatcc tcggctcctg cctcactagc tgcggagcct ctcccgctcg
121 gtccacgctg ccgggcggcc acgaccgtga cccttcccct cgggccgccc agatccatgc
181 ctcgtcccac gggacaccag ttccctggcg tgtgcagacc ccccggcgcc taccatgctg
241 tacgtcggtg accccgcacg gcacctcgcc acggcccagt tcaatctgct gagcagcacc
301 atggaccaga tgagcagccg cgcggcctcg gccagcccct acaccccaga gcacgccgcc
361 agcgtgccca cccactcgcc ctacgcacaa cccagctcca ccttcgacac catgtcgccg
421 gcgcctgtca tcccctccaa caccgactac cccggacccc accactttga ggtcactttc
481 cagcagtcca gcacggccaa gtcagccacc tggacgtact ccccgctctt gaagaaactc
541 tactgccaga tcgccaagac atgccccatc cagatcaagg tgtccacccc gccaccccca
601 ggcaccgcca tccgggccat gcctgtttac aagaaagcgg agcacgtgac cgacgtcgtg
661 aaacgctgcc ccaaccacga gctcgggagg gacttcaacg aaggacagtc tgctccagcc
721 agccacctca tccgcgtgga aggcaataat ctctcgcagt atgtggatga ccctgtcacc
781 ggcaggcaga gcgtcgtggt gccctatgag ccaccacagg tggggacgga attcaccacc
841 atcctgtaca acttcatgtg taacagcagc tgtgtagggg gcatgaaccg gcggcccatc
901 ctcatcatca tcaccctgga gatgcgggat gggcaggtgc tgggccgccg gtcctttgag
961 ggccgcatct gcgcctgtcc tggccgcgac cgaaaagctg atgaggacca ctaccgggag
1021 cagcaggccc tgaacgagag ctccgccaag aacggggccg ccagcaagcg tgccttcaag
1081 cagagccccc ctgccgtccc cgcccttggt gccggtgtga agaagcggcg gcatggagac
1141 gaggacacgt actaccttca ggtgcgaggc cgggagaact ttgagatcct gatgaagctg
1201 aaagagagcc tggagctgat ggagttggtg ccgcagccac tggtggactc ctatcggcag
1261 cagcagcagc tcctacagag gccgacctgg gggccctgaa gatccccgag cagtaccgca
1321 tgaccatctg gcggggcctg caggacctga agcagggcca cgactacagc accgcgcagc
1381 agctgctccg ctctagcaac gcggccacca tctccatcgg cggctcaggg gaactgcagc
1441 gccagcgggt catggaggcc gtgcacttcc gcgtgcgcca caccatcacc atccccaacc
1501 gcggcggccc aggcggcggc cctgacgagt gggcggactt cggcttcgac ctgcccgact
1561 gcaaggcccg caagcagccc atcaaggagg agttcacgga ggccgagatc cactgagggc
1621 ctcgcctggc tgcagcctgc gccaccgccc agagacccaa gctgcctccc ctctccttcc
1681 tgtgtgtcca aaactgcctc aggaggcagg accttcgggc tgtgcccggg gaaaggcaag
1741 gtccggccca tccccaggca cctcacaggc cccaggaaag gcccagccac cgaagccgcc
1801 tgtggacagc ctgagtcacc tgcagaacct tctggagctg ccctagtgct gggcttgtgg
1861 ggcgggggct ggcccactct cagccctgcc actgccccgg cgtgctccat ggcaggcgtg
1921 ggtggggacc gcagcgtcgg ctccgacttc caggcttcat cctagagact gtcatctccc
1981 aaccaggcga ggtccttcca aaggaaagga tcctctttgc tgatggactg ccaaaaagta
2041 ttttgcgaca tcttttggtt ctggatagta gtgagcagcc aagtgactgt gtctgaaaca
2101 ccagtgtatt ttcagggaat gtccctaact gcgtcttgcc cgcgccgggg gctggggact
2161 ctctctgctg gacttgggac tggcctctgc ccccagcacg ctgtattctg caggaccgcc
2221 tccttcctgc ccctaacaac aaccacagtg ttgctgaaat tggagaaaac tggggagggc TABLE 1-continued 2281 gcaaccccc ccaggcgcgg ggaagcatgt ggtaccgcct cagccagtgc ccctcagcct
2341 ggccacagtc gcctctcctc ggggacccct cagcagaaag ggacagcctg tccttagagg
2401 actggaaatt gtcaatattt gataaaatga taccctttc tacatggtgg gtcagctttt
2461 ttttttttt ttttaacttt ctttctcagc attctctttg gagttcaacc tagcgcccat
2521 gagccaggct gaggaagctg agtgagaagc caggtgggcg ggacttgttc ccaggaaggc
2581 cgggtgggga ggaagcctag agggaacccc aggaagggca aatccaggca aatctgcagg
2641 aatgctctgc catgggagca gctcctccct tgccacggcc accttctcta gcactgcaag
2701 gtccacaggg cattgctttc ctttctaggc ggtggcagtc agggaacaga ctgaggtagg
2761 tgtagggggg tctaggcctt cgtggagcac cccagggagt tagtaggccc cggggagaca
2821 gagtctgcac aggccctttc tggggccacc tccatccacg aggagcagcc tgagccttgg
2881 tggccgaacc ttgaccgtcc cggagcacag cttcagggca gggaaccgga gcccctgggg
2941 ggcctcacgg gtgtgacgag gcccttcatt gcaggcaggt gggccaatgg gagccctcac
3001 ccacgcaagc cgagacacca cccagagtgc aggctgcctg gccccttctg gcacggccag
3061 ctccacaccc cctgcctagg gtatgtgtgg tcctaagggc taggagcttc ccctactaac
3121 atctcccaga aaaagcagtt aagcccctca gggcacagca aggttagaca cagcccccat
3181 ccccagatca ggactccatc ttgctaagtg gcatcaccgt caccagcctc cccttattta
3241 aaagcagcga ctggtgttgc cgcaggtacc tggtctacga agacgcaggc atccctctcc
3301 caccgtccac ctccccgggg gccgctgaca gcacagtcgc ctgggtgcac gcttgtgggg
3361 gcagcaggaa cggggctgtc ggctctcagg ggatctggct gcagccaggg cgagggcctg
3421 gcccttcctt ccagctcctt ccggctcctt ccagctgaag ggcaggaagc tctggccgct
3481 tagcttctag ggttccatct ccctagaaag gtgcccacgc ccagggcatc agtcagtagc
3541 ggcagcagca gcagactcgg ggctttccca gggtggcgca gccaccccag ctgcatgtca
3601 cctcagctct ccatcttatt gccattttgt agatgaggaa gctgagacca gaaaggctaa
3661 gacccatgcc ccaggcacca cacccatctc ttgggggctg ggcacctgct acccgaggcc
3721 acctcctgaa gcccccactc ttcccccatg ttccacttca ggagccgcgg gggcccatcc
3781 tgacacccgg ggttcctcag cccagcgcag atgtgcttca gttccagagg gcttgttgat
3841 ttgtttctta ggtacgttac ctgtccaccc tgagtccagt gaggctgtcc caagagcccc
3901 tgtagtgtgc tcctgggaag ggctgggggg gctggggggg ctgggagagg cccaggggca
3961 gctgtcactg gaaccccagc cagatgtcca aggaagccgg ccagaacacg gagcagccag
4021 atggccccag ctgcacctgt ctagggagcc catgcagcct ccttgcactg gagaagcagc
4081 tgtgaaagta gacagagttg agacttcgcc gtggtcagga gaaaatgcaa attcccagga
4141 acaagaatcc tttaagtgat atgtttttat aaaactaaac aaatcaacaa ataaatcttg
4201 aaggcggatg gttttcccag cagtgcaggg gttggaggga ggctgctggc actcctgggg
4261 ccaaggggga caggcagtgg tcctgagtct gctcagagag gcaaggcaga aggagctcgc
4321 caggcaggtc agctcacatc tgtccaagtc gctctggtca gaaacagcga ctctccccca
4381 ttcccccagc gttcccacca ggcctgggct gctgggaagc ccttgctgta cccaggagcc
4441 cgacccgcag tatcctggca cagagccact tgtcactcag aacagtcagt gtctccaacg
4501 cacaaacatc cactcctctg ttaccagtta aagcacttta atgctttaag gtgaaaacga
4561 aatcccatcc gtgtttttcg tgtaagatcg tgcttctccg agcagtatta atggacgccc
4621 tccaatgaca taacaactgt ttttggtaat gtaatcttgg gaaaatgtgt tattttttta
4681 gctgtgtttc agtggggatt tttgtttttg taacataata aagtgtatgt tccaatga SEQ ID NO: 111 Human TP73 isoform 5 amino acid sequence (NP_001191118.1)
1 mlyvgdparh lataqfnlls stmdqmssra asaspytpeh aasvpthspy aqpsstfdtm
61 spapvipsnt dypgphhfev tfqqsstaks atwtyspllk klycqiaktc piqikvstpp
121 ppgtairamp vykkaehvtd vvkrcpnhel grdfnegqsa pashlirveg nnlsqyvddp
181 vtgrqsvvvp yeppqvgtef ttilynfmcn sscvggmnrr piliiitlem rdgqvlgrrs
241 fegricacpg rdrkadedhy reqqalness akngaaskra fkqsppavpa lgagvkkrrh
301 gdedtyylqv rgrenfeilm klkeslelme lvpqplvdsy rqqqllqrp twgp SEQ ID NO: 112 Human TP73 transcript variant 6 cDNA sequence
(NM_001204190.2; CDS: 235-1755)
1 ggattcagcc agttgacaga actaagggag atgggaaaag cgaaaatgcc aacaaacggc
61 ccgcatgttc cccagcatcc tcggctcctg cctcactagc tgcggagcct ctcccgctcg
121 gtccacgctg ccgggcggcc acgaccgtga cccttcccct cgggccgccc agatccatgc
181 ctcgtcccac gggacaccag ttccctggcg tgtgcagacc ccccggcgcc taccatgctg
241 tacgtcggtg accccgcacg gcacctcgcc acggcccagt tcaatctgct gagcagcacc
301 atggaccaga tgagcagccg cgcggcctcg gccagcccct acaccccaga gcacgccgcc
361 agcgtgccca cccactcgcc ctacgcacaa cccagctcca ccttcgacac catgtcgccg
421 gcgcctgtca tcccctccaa caccgactac cccggacccc accactttga ggtcactttc
481 cagcagtcca gcacggccaa gtcagccacc tggacgtact ccccgctctt gaagaaactc
541 tactgccaga tcgccaagac atgccccatc cagatcaagg tgtccacccc gccaccccca
601 ggcaccgcca tccgggccat gcctgtttac aagaaagcgg agcacgtgac cgacgtcgtg
661 aaacgctgcc ccaaccacga gctcgggagg gacttcaacg aaggacagtc tgctccagcc
721 agccacctca tccgcgtgga aggcaataat ctctcgcagt atgtggatga ccctgtcacc
781 ggcaggcaga gcgtcgtggt gccctatgag ccaccacagg tggggacgga attcaccacc
841 atcctgtaca acttcatgtg taacagcagc tgtgtagggg gcatgaaccg gcggcccatc
901 ctcatcatca tcaccctgga gatgcgggat gggcaggtgc tgggccgccg gtcctttgag
961 ggccgcatct gcgcctgtcc tggccgcgac cgaaaagctg atgaggacca ctaccgggag
1021 cagcaggccc tgaacgagag ctccgccaag aacggggccg ccagcaagcg tgccttcaag
1081 cagagccccc ctgccgtccc cgcccttggt gccggtgtga agaagcggcg gcatggagac
1141 gaggacacgt actaccttca ggtgcgaggc cgggagaact ttgagatcct gatgaagctg
1201 aaagagagcc tggagctgat ggagttggtg ccgcagccac tggtggactc ctatcggcag
1261 cagcagcagc tcctacagag gccgccccgg gatgctcaac aaccatggcc acgcagtgcc
1321 agccaacggc gagatgagca gcagccacag cgcccagtcc atggtctcgg ggtcccactg
1381 cactccgcca cccccctacc acgccgaccc cagcctcgtc aggacctggg ggccctgaag
1441 atccccgagc agtaccgcat gaccatctgg cggggcctgc aggacctgaa gcagggccac
1501 gactacagca ccgcgcagca gctgctccgc tctagcaacg cggccaccat ctccatcggc
1561 ggctcagggg aactgcagcg ccagcgggtc atggaggccg tgcacttccg cgtgcgccac
1621 accatcacca tccccaaccg cggcggccca ggcggcggcc ctgacgagtg ggcggacttc TABLE 1-continued 1681 ggcttcgacc tgcccgactg caaggcccgc aagcagccca tcaaggagga gttcacggag
1741 gccgagatcc actgagggcc tcgcctggct gcagcctgcg ccaccgccca gagacccaag
1801 ctgcctcccc tctccttcct gtgtgtccaa aactgcctca ggaggcagga ccttcgggct
1861 gtgcccgggg aaaggcaagg tccggcccat ccccaggcac ctcacaggcc ccaggaaagg
1921 cccagccacc gaagccgcct gtggacagcc tgagtcacct gcagaacctt ctggagctgc
1981 cctagtgctg ggcttgtggg gcgggggctg gcccactctc agccctgcca ctgccccggc
2041 gtgctccatg gcaggcgtgg gtggggaccg cagcgtcggc tccgacttcc aggcttcatc
2101 ctagagactg tcatctccca accaggcgag gtccttccaa aggaaaggat cctctttgct
2161 gatggactgc caaaaagtat tttgcgacat cttttggttc tggatagtag tgagcagcca
2221 agtgactgtg tctgaaacac cagtgtattt tcagggaatg tccctaactg cgtcttgccc
2281 gcgccggggg ctggggactc tctctgctgg acttgggact ggcctctgcc cccagcacgc
2341 tgtattctgc aggaccgcct ccttcctgcc cctaacaaca accacagtgt tgctgaaatt
2401 ggagaaaact ggggagggcg caaccccccc caggcgcggg gaagcatgtg gtaccgcctc
2461 agccagtgcc cctcagcctg gccacagtcg cctctcctcg gggacccctc agcagaaagg
2521 gacagcctgt ccttagagga ctggaaattg tcaatatttg ataaaatgat acccttttct
2581 acatggtggg tcagcttttt tttttttttt tttaactttc tttctcagca ttctctttgg
2641 agttcaacct agcgcccatg agccaggctg aggaagctga gtgagaagcc aggtgggcgg
2701 gacttgttcc caggaaggcc gggtggggag gaagcctaga gggaacccca ggaagggcaa
2761 atccaggcaa atctgcagga atgctctgcc atgggagcag ctcctccctt gccacggcca
2821 ccttctctag cactgcaagg tccacagggc attgctttcc tttctaggcg gtggcagtca
2881 gggaacagac tgaggtaggt gtaggggggt ctaggccttc gtggagcacc ccagggagtt
2941 agtaggcccc ggggagacag agtctgcaca ggccctttct ggggccacct ccatccacga
3001 ggagcagcct gagccttggt ggccgaacct tgaccgtccc ggagcacagc ttcagggcag
3061 ggaaccggag cccctggggg gcctcacggg tgtgacgagg cccttcattg caggcaggtg
3121 ggccaatggg agccctcacc cacgcaagcc gagacaccac ccagagtgca ggctgcctgg
3181 cccctctgg cacggccagc tccacacccc ctgcctaggg tatgtgtggt cctaagggct
3241 aggagcttcc cctactaaca tctcccagaa aaagcagtta agcccctcag ggcacagcaa
3301 ggttagacac agcccccatc cccagatcag gactccatct tgctaagtgg catcaccgtc
3361 accagcctcc ccttatttaa aagcagcgac tggtgttgcc gcaggtacct ggtctacgaa
3421 gacgcaggca tccctctccc accgtccacc tccccggggg ccgctgacag cacagtcgcc
3481 tgggtgcacg cttgtggggg cagcaggaac ggggctgtcg gctctcaggg gatctggctg
3541 cagccagggc gagggcctgg cccttccttc cagctccttc cggctccttc cagctgaagg
3601 gcaggaagct ctggccgctt agcttctagg gttccatctc cctagaaagg tgcccacgcc
3661 cagggcatca gtcagtagcg gcagcagcag cagactcggg gctttcccag ggtggcgcag
3721 ccaccccagc tgcatgtcac ctcagctctc catcttattg ccattttgta gatgaggaag
3781 ctgagaccag aaaggctaag acccatgccc caggcaccac acccatctct tgggggctgg
3841 gcacctgcta cccgaggcca cctcctgaag cccccactct tcccccatgt tccacttcag
3901 gagccgcggg ggcccatcct gacacccggg gttcctcagc ccagcgcaga tgtgcttcag
3961 ttccagaggg cttgttgatt tgtttcttag gtacgttacc tgtccaccct gagtccagtg
4021 aggctgtccc aagagcccct gtagtgtgct cctgggaagg gctggggggg ctgggggggc
4081 tgggagaggc ccaggggcag ctgtcactgg aaccccagcc agatgtccaa ggaagccggc
4141 cagaacacgg agcagccaga tggccccagc tgcacctgtc tagggagccc atgcagcctc
4201 cttgcactgg agaagcagct gtgaaagtag acagagttga gacttcgccg tggtcaggag
4261 aaaatgcaaa ttcccaggaa caagaatcct ttaagtgata tgtttttata aaactaaaca
4321 aatcaacaaa taaatcttga aggcggatgg ttttcccagc agtgcagggg ttggagggag
4381 gctgctggca ctcctggggc caagggggac aggcagtggt cctgagtctg ctcagagagg
4441 caaggcagaa ggagctcgcc aggcaggtca gctcacatct gtccaagtcg ctctggtcag
4501 aaacagcgac tctcccccat tcccccagcg ttcccaccag gcctgggctg ctgggaagcc
4561 cttgctgtac ccaggagccc gacccgcagt atcctggcac agagccactt gtcactcaga
4621 acagtcagtg tctccaacgc acaaacatcc actcctctgt taccagttaa agcactttaa
4681 tgctttaagg tgaaaacgaa atcccatccg tgtttttcgt gtaagatcgt gcttctccga
4741 gcagtattaa tggacgccct ccaatgacat aacaactgtt tttggtaatg taatcttggg
4801 aaaatgtgtt attttttag ctgtgtttca gtggggattt ttgtttttgt aacataataa
4861 agtgtatgtt ccaatga SEQ ID NO: 113 Human TP73 isoform 6 amino acid sequence (NP_001191119.1)
1 mlyvgdparh lataqfnlls stmdqmssra asaspytpeh aasvpthspy aqpsstfdtm
61 spapvipsnt dypgphhfev tfqqsstaks atwtyspllk klycqiaktc piqikvstpp
121 ppgtairamp vykkaehvtd vvkrcpnhel grdfnegqsa pashlirveg nnlsqyvddp
181 vtgrqsvvvp yeppqvgtef ttilynfmcn sscvggmnrr piliiitlem rdgqvlgrrs
241 fegricacpg rdrkadedhy reqqalness akngaaskra fkqsppavpa lgagvkkrrh
301 gdedtyylqv rgrenfeilm klkesleime lvpqplvdsy rqqqqllqrp prdaqqpwpr
361 sasqrrdeqq pqrpvhglgv plhsatplpr rpqprqdlga lkipeqyrmt iwrglqdlkq
421 ghdystaqql lrssnaatis iggsgelqrq rvmeavhfrv rhtitipnrg gpgggpdewa
481 dfgfdlpdck arkqpikeef teaeih SEQ ID NO: 114 Human TP73 transcript variant 7 cDNA sequence
(NM_001204191.2; CDS: 235-1710)
1 ggattcagcc agttgacaga actaagggag atgggaaaag cgaaaatgcc aacaaacggc
61 ccgcatgttc cccagcatcc tcggctcctg cctcactagc tgcggagcct ctcccgctcg
121 gtccacgctg ccgggcggcc acgaccgtga cccttcccct cgggccgccc agatccatgc
181 ctcgtcccac gggacaccag ttccctggcg tgtgcagacc ccccggcgcc taccatgctg
241 tacgtcggtg accccgcacg gcacctcgcc acggcccagt tcaatctgct gagcagcacc
301 atggaccaga tgagcagccg cgcggcctcg gccagcccct acaccccaga gcacgccgcc
361 agcgtgccca cccactcgcc ctacgcacaa cccagctcca ccttcgacac catgtcgccg
421 gcgcctgtca tcccctccaa caccgactac cccggacccc accactttga ggtcactttc
481 cagcagtcca gcacggccaa gtcagccacc tggacgtact ccccgctctt gaagaaactc
541 tactgccaga tcgccaagac atgccccatc cagatcaagg tgtccacccc gccaccccca
601 ggcaccgcca tccgggccat gcctgtttac aagaaagcgg agcacgtgac cgacgtcgtg
661 aaacgctgcc ccaaccacga gctcgggagg gacttcaacg aaggacagtc tgctccagcc TABLE 1-continued

```
 721 agccacctca tccgcgtgga aggcaataat ctctcgcagt atgtggatga ccctgtcacc
 781 ggcaggcaga gcgtcgtggt gccctatgag ccaccacagg tggggacgga attcaccacc
 841 atcctgtaca acttcatgtg taacagcagc tgtgtagggg gcatgaaccg gcggcccatc
 901 ctcatcatca tcaccctgga gatgcgggat gggcaggtgc tgggccgccg gtcctttgag
 961 ggccgcatct gcgcctgtcc tggccgcgac cgaaaagctg atgaggacca ctaccgggag
1021 cagcaggccc tgaacgagag ctccgccaag aacggggccg ccagcaagcg tgccttcaag
1081 cagagccccc ctgccgtccc cgcccttggt gccggtgtga agaagcggcg gcatggagac
1141 gaggacacgt actaccttca ggtgcgaggc cgggagaact ttgagatcct gatgaagctg
1201 aaagagagcc tggagctgat ggagttggtg ccgcagccac tggtggactc ctatcggcag
1261 cagcagcagc tcctacagag gccttttttta acaggattgg ggtgtccaaa ctgcatcgag
1321 tatttcacct cccaagggtt acagagcatt taccacctgc agaacctgac cattgaggac
1381 ctgggggccc tgaagatccc cgagcagtac cgcatgacca tctggcgggg cctgcaggac
1441 ctgaagcagg gccacgacta cagcaccgcg cagcagctgc tccgctctag caacgcggcc
1501 accatctcca tcggcggctc aggggaactg cagcgccagc gggtcatgga ggccgtgcac
1561 ttccgcgtgc gccacaccat caccatcccc aaccgcggcg gcccaggcgg cggccctgac
1621 gagtgggcgg acttcggctt cgacctgccc gactgcaagg cccgcaagca gcccatcaag
1681 gaggagttca cggaggccga gatccactga gggcctcgcc tggctgcagc ctgcgccacc
1741 gcccagagac ccaagctgcc tcccctctcc ttcctgtgtg tccaaaactg cctcaggagg
1801 caggaccttc gggctgtgcc cggggaaagg caaggtccgg cccatcccca ggcacctcac
1861 aggccccagg aaaggcccag ccaccgaagc cgcctgtgga cagcctgagt cacctgcaga
1921 accttctgga gctgccctag tgctgggctt gtggggcggg ggctggccca ctctcagccc
1981 tgccactgcc ccggcgtgct ccatggcagg cgtgggtggg gaccgcagcg tcggctccga
2041 cttccaggct tcatcctaga gactgtcatc tcccaaccag gcgaggtcct tccaaaggaa
2101 aggatcctct ttgctgatgg actgccaaaa agtattttgc gacatctttt ggttctggat
2161 agtagtgagc agccaagtga ctgtgtctga aacaccagtg tattttcagg gaatgtccct
2221 aactgcgtct tgcccgcgcc ggggggctggg gactctctct gctggacttg ggactggcct
2281 ctgcccccag cacgctgtat tctgcaggac cgcctccttc ctgcccctaa caacaaccac
2341 agtgttgctg aaattggaga aaactgggga gggcgcaacc ccccccaggc gcggggaagc
2401 atgtggtacc gcctcagcca gtgcccctca gcctggccac agtcgcctct cctcggggac
2461 ccctcagcag aaagggacag cctgtcctta gaggactgga aattgtcaat atttgataaa
2521 atgataccct tttctacatg gtgggtcagc tttttttttt ttttttttaa ctttctttct
2581 cagcattctc tttggagttc aacctagcgc ccatgagcca ggctgaggaa gctgagtgag
2641 aagccaggtg ggcgggactt gttcccagga aggccgggtg gggaggaagc ctagagggaa
2701 ccccaggaag ggcaaatcca ggcaaatctg caggaatgct ctgccatggg agcagctcct
2761 cccttgccac ggccaccttc tctagcactg caaggtccac agggcattgc tttcctttct
2821 aggcggtggc agtcagggaa cagactgagg taggtgtagg ggggtctagg ccttcgtgga
2881 gcaccccagg gagttagtag gccccgggga gacagagtct gcacaggccc tttctggggc
2941 cacctccatc cacgaggagc agcctgagcc ttggtggccg aaccttgacc gtcccggagc
3001 acagcttcag ggcagggaac cggagcccct ggggggcctc acgggtgtga cgaggccctt
3061 cattgcaggc aggtgggcca atgggagccc tcacccacgc aagccgagac accacccaga
3121 gtgcaggctg cctggcccct tctggcacgg ccagctccac acccccctgcc tagggtatgt
3181 gtggtcctaa gggctaggag cttcccctac taacatctcc cagaaaaagc agttaagccc
3241 ctcagggcac agcaaggtta gacacagccc ccatccccag atcaggactc catcttgcta
3301 agtggcatca ccgtcaccag cctcccctta tttaaaagca gcgactggtg ttgccgcagg
3361 tacctggtct acgaagacgc aggcatccct ctcccaccgt ccacctcccc gggggccgct
3421 gacagcacag tcgcctgggt gcacgcttgt gggggcagca ggaacggggc tgtcggctct
3481 caggggatct ggctgcagcc agggcgaggg cctggccctt ccttccagct ccttccggct
3541 ccttccagct gaagggcagg aagctctggc cgcttagctt ctagggttcc atctccctag
3601 aaaggtgccc acgcccaggg catcagtcag tagcggcagc agcagcagac tcggggcttt
3661 cccagggtgg cgcagccacc ccagctgcat gtcacctcag ctctccatct tattgccatt
3721 ttgtagatga ggaagctgag accagaaagg ctaagaccca tgccccaggc accacaccca
3781 tctcttgggg gctgggcacc tgctacccga ggccacctcc tgaagccccc actcttcccc
3841 catgttccac ttcaggagcc gcgggggccc atcctgacac ccggggttcc tcagcccagc
3901 gcagatgtgc ttcagttcca gagggcttgt tgatttgttt cttaggtacg ttacctgtcc
3961 accctgagtc cagtgaggct gtcccaagag cccctgtagt gtgctcctgg gaagggctgg
4021 gggggctggg ggggctggga gaggcccagg ggcagctgtc actggaaccc cagccagatg
4081 tccaaggaag ccggccagaa cacggagcag ccagatggcc ccagctgcac ctgtctaggg
4141 agcccatgca gcctccttgc actggagaag cagctgtgaa agtagacaga gttgagactt
4201 cgccgtggtc aggagaaaat gcaaattccc aggaacaaga atcctttaag tgatatgttt
4261 ttataaaact aaacaaatca acaaataaat cttgaaggcg gatggttttc ccagcagtgc
4321 aggggttgga gggaggctgc tggcactcct ggggccaagg gggacaggca gtggtcctga
4381 gtctgctcag agaggcaagg cagaaggagc tcgccaggca ggtcagctca catctgtcca
4441 agtcgctctg gtcagaaaca gcgactctcc cccattcccc cagcgttccc accaggcctg
4501 ggctgctggg aagcccttgc tgtacccagg agcccgaccc gcagtatcct ggcacagagc
4561 cacttgtcac tcagaacagt cagtgtctcc aacgcacaaa catccactcc tctgttacca
4621 gttaaagcac tttaatgctt taaggtgaaa acgaaatccc atccgtgttt ttcgtgtaag
4681 atcgtgcttc tccgagcagt attaatggac gccctccaat gacataacaa ctgtttttgg
4741 taatgtaatc ttgggaaaat gtgttatttt tttagctgtg tttcagtggg gatttttgtt
4801 tttgtaacat aataaagtgt atgttccaat ga
```

SEQ ID NO: 115 Human TP73 isoform 7 amino acid sequence (NP_001191120.1)

```
  1 mlyvgdparh lataqfnlls stmdqmssra asaspytpeh aasvpthspy aqpsstfdtm
 61 spapvipsnt dypgphhfev tfqqsstaks atwtyspllk klycqiaktc piqikvstpp
121 ppgtairamp vykkaehvtd vvkrcpnhel grdfnegqsa pashlirveg nnlsqyvddp
181 vtgrqsvvvp yeppqvgtef ttilynfmcn sscvggmnrr piliiitlem rdgqvlgrrs
241 fegricacpg rdrkadedhy reqqalness akngaaskra fkqsppavpa lgagvkkrrh
301 gdedtyylqv rgrenfeilm klkesleime lvpqplvdsy rqqqqllqrp fltglgcpnc
361 ieyftsqglq siyhlqnlti edlgalkipe qyrmtiwrgl qdlkqghdys taqqllrssn
421 aatisiggsg elqrqrvmea vhfrvrhtit ipnrggpggg pdewadfgfd lpdckarkqp
481 ikeefteaei h
```

TABLE 1-continued

SEQ ID NO: 116 Human TP73 transcript variant 8 cDNA sequence
(NM_001204184.2; CDS: 160-1659)

```
   1 gccctgcctc cccgcccgcg cacccgcccg gaggctcgcg cgcccgcgaa ggggacgcag
  61 cgaaaccggg gcccgcgcca ggccagccgg gacggacgcc gatgcccggg gctgcgacgg
 121 ctgcagagcg agctgccctc ggaggccggc gtggggaaga tggcccagtc caccgccacc
 181 tcccctgatg ggggcaccac gtttgagcac ctctggagct ctctggaacc agacagcacc
 241 tacttcgacc ttccccagtc aagccggggg aataatgagg tggtgggcgg aacggattcc
 301 agcatggacg tcttccacct ggagggcatg actacatctg tcatggccca gttcaatctg
 361 ctgagcagca ccatggacca gatgagcagc cgcgcggcct cggccagccc ctacacccca
 421 gagcacgccg ccagcgtgcc cacccactcg ccctacgcac aacccagctc caccttcgac
 481 accatgtcgc cggcgcctgt catcccctcc aacaccgact accccggacc ccaccacttt
 541 gaggtcactt tccagcagtc cagcacggcc aagtcagcca cctggacgta ctccccgctc
 601 ttgaagaaac tctactgcca gatcgccaag acatgcccca tccagatcaa ggtgtccacc
 661 ccgccacccc caggcaccgc catccgggcc atgcctgttt acaagaaagc ggagcacgtg
 721 accgacgtcg tgaaacgctg ccccaaccac gagctcggga gggacttcaa cgaaggacag
 781 tctgctccag ccagccacct catccgcgtg gaaggcaata atctctcgca gtatgtggat
 841 gaccctgtca ccggcaggca gagcgtcgtg gtgccctatg agccaccaca ggtggggacg
 901 gaattcacca ccatcctgta caacttcatg tgtaacagca gctgtgtagg gggcatgaac
 961 cggcggccca tcctcatcat catcaccctg gagatgcggg atgggcaggt gctgggccgc
1021 cggtcctttg agggccgcat ctgcgcctgt cctggccgcg accgaaaagc tgatgaggac
1081 cactaccggg agcagcaggc cctgaacgag agctccgcca agaacggggc cgccagcaag
1141 cgtgccttca agcagagccc ccctgccgtc cccgcccttg gtgccggtgt gaagaagcgg
1201 cggcatggag acgaggacac gtactacctt caggtgcgag gccgggagaa ctttgagatc
1261 ctgatgaagc tgaaagagag cctggagctg atggagttgg tgccgcagcc actggtggac
1321 tcctatcggc agcagcagca gctcctacag aggccgagtc acctacagcc cccgtcctac
1381 gggccggtcc tctcgcccat gaacaaggtg cacggggggca tgaacaagct gccctccgtc
1441 aaccagctgg tgggccagcc tcccccgcac agttcggcag ctacacccaa cctggggccc
1501 gtgggccccg ggatgctcaa caaccatggc cacgcagtgc cagccaacgg cgagatgagc
1561 agcagccaca gcgcccagtc catggtctcg gggtcccact gcactccgcc accccccctac
1621 cacgccgacc ccagcctcgt caggacctgg gggccctgaa gatccccgag cagtaccgca
1681 tgaccatctg gcggggcctg caggacctga agcagggcca cgactacagc accgcgcagc
1741 agctgctccg ctctagcaac gcggccacca tctccatcgg cggctcaggg gaactgcagc
1801 gccagcgggt catggaggcc gtgcacttcc gcgtgcgcca caccatcacc atccccaacc
1861 gcggcggccc aggcggcggc cctgacgagt gggcggactt cggcttcgac ctgcccgact
1921 gcaaggcccg caagcagccc atcaaggagg agttcacgga ggccgagatc cactgagggc
1981 ctcgcctggc tgcagcctgc gccaccgccc agagacccaa gctgcctccc ctctccttcc
2041 tgtgtgtcca aaactgcctc aggaggcagg accttcgggc tgtgcccggg gaaaggcaag
2101 gtccggccca tccccaggca cctcacaggc cccaggaaag gcccagccac cgaagccgcc
2161 tgtggacagc ctgagtcacc tgcagaacct tctggagctg ccctagtgct gggcttgtgg
2221 ggcgggggct ggcccactct cagccctgcc actgccccgg cgtgctccat ggcaggcgtg
2281 ggtggggacc gcagcgtcgg ctccgacttc caggcttcat cctagagact gtcatctccc
2341 aaccaggcga ggtccttcca aaggaaagga tcctctttgc tgatggactg ccaaaaagta
2401 ttttgcgaca tcttttggtt ctggatagta gtgagcagcc aagtgactgt gtctgaaaca
2461 ccagtgtatt ttcagggaat gtccctaact gcgtcttgcc cgcgccgggg gctggggact
2521 ctctctgctg gacttgggac tggcctctgc ccccagcacg ctgtattctg caggaccgcc
2581 tccttcctgc ccctaacaac aaccacagtg ttgctgaaat tggagaaaac tggggagggc
2641 gcaacccccc ccaggcgcgg ggaagcatgt ggtaccgcct cagccagtgc ccctcagcct
2701 ggccacagtc gcctctcctc ggggacccct cagcagaaag ggacagcctg tccttagagg
2761 actggaaatt gtcaatattt gataaaatga taccctttc tacatggtgg gtcagctttt
2821 ttttttttt ttttaacttt ctttctcagc attctctttg gagttcaacc tagcgcccat
2881 gagccaggct gaggaagctg agtgagaagc caggtgggcg ggacttgttc ccaggaaggc
2941 cgggtgggga ggaagcctag agggaacccc aggaagggca aatccaggca aatctgcagg
3001 aatgctctgc catgggagca gctcctccct tgccacggcc accttctcta gcactgcaag
3061 gtccacaggg cattgctttc ctttctaggc ggtggcagtc agggaacaga ctgaggtagg
3121 tgtagggggg tctaggcctt cgtggagcac cccagggagt tagtaggccc cggggagaca
3181 gagtctgcac aggccctttc tggggccacc tccatccacg aggagcagcc tgagccttgg
3241 tggccgaacc ttgaccgtcc cggagcacag cttcagggca gggaaccgga gcccctgggg
3301 ggcctcacgg gtgtgacgag gcccttcatt gcaggcaggt gggccaatgg gagccctcac
3361 ccacgcaagc cgagacacca cccagagtgc aggctgcctg gccccttctg gcacggccag
3421 ctccacaccc cctgcctagg gtatgtgtgg tcctaagggc taggagcttc ccctactaac
3481 atctcccaga aaaagcagtt aagcccctca gggcacagca aggttagaca cagcccccat
3541 ccccagatca ggactccatc ttgctaagtg gcatcaccgt caccagcctc cccttattta
3601 aaagcagcga ctggtgttgc cgcaggtacc tggtctacga agacgcaggc atccctctcc
3661 caccgtccac ctccccgggg gccgctgaca gcacagtcgc ctgggtgcac gcttgtgggg
3721 gcagcaggaa cggggctgtc ggctctcagg ggatctggct gcagccaggg cgagggcctg
3781 gcccttccct ccagctcctt ccggctcctt ccagctgaag ggcaggaagc tctggccgct
3841 tagcttctag ggttccatct ccctagaaag gtgcccacgc ccagggcatc agtcagtagc
3901 ggcagcagca gcagactcgg ggctttccca gggtggcgca gccaccccag ctgcatgtca
3961 cctcagctct ccatcttatt gccattttgt agatgaggaa gctgagacca gaaaggctaa
4021 gacccatgcc ccaggcacca cacccatctc ttgggggctg ggcacctgct acccgaggcc
4081 acctcctgaa gcccccactc ttcccccatg ttccacttca ggagccgcgg gggcccatcc
4141 tgacacccgg ggttcctcag cccagcgcag atgtgcttca gttccagagg gcttgttgat
4201 ttgtttctta ggtacgttac ctgtccaccc tgagtccagt gaggctgtcc caagagcccc
4261 tgtagtgtgc tcctgggaag ggctgggggg gctgggggg ctgggagagg cccaggggca
4321 gctgtcactg gaaccccagc cagatgtcca aggaagccgg ccagaacacg gagcagccag
4381 atggccccag ctgcacctgt ctagggagcc catgcagcct ccttgcactg gagaagcagc
4441 tgtgaaagta gacagagttg agacttcgcc gtggtcagga gaaaatgcaa attcccagga
4501 acaagaatcc tttaagtgat atgtttttat aaaactaaac aaatcaacaa ataaatcttg
4561 aaggcggatg gttttcccag cagtgcaggg gttggaggga ggctgctggc actcctgggg
```

TABLE 1-continued

```
4621 ccaaggggga caggcagtgg tcctgagtct gctcagagag gcaaggcaga aggagctcgc
4681 caggcaggtc agctcacatc tgtccaagtc gctctggtca gaaacagcga ctctccccca
4741 ttcccccagc gttcccacca ggcctgggct gctgggaagc ccttgctgta cccaggagcc
4801 cgacccgcag tatcctggca cagagccact tgtcactcag aacagtcagt gtctccaacg
4861 cacaaacatc cactcctctg ttaccagtta aagcacttta atgctttaag gtgaaaacga
4921 aatcccatcc gtgtttttcg tgtaagatcg tgcttctccg agcagtatta atggacgccc
4981 tccaatgaca taacaactgt ttttggtaat gtaatcttgg gaaaatgtgt tattttttta
5041 gctgtgtttc agtggggatt tttgtttttg taacataata aagtgtatgt tccaatga

SEQ ID NO: 117 Human TP73 isoform 8 amino acid sequence (NP_001191113.1)
  1 maqstatspd ggttfehlws slepdstyfd lpqssrgnne vvggtdssmd vfhlegmtts
 61 vmaqfnllss tmdqmssraa saspytpeha asvpthspya qpsstfdtms papvipsntd
121 ypgphhfevt fqqsstaksa twtyspllkk lycqiaktcp iqikvstppp pgtairampv
181 ykkaehvtdv vkrcpnhelg rdfnegqsap ashlirvegn nlsqyvddpv tgrqsvvvpy
241 eppqvgteft tilynfmcns scvggmnrrp iliiitlemr dgqvlgrrsf egricacpgr
301 drkadedhyr eqqalnessa kngaaskraf kqsppavpal gagvkkrrhg dedtyylqvr
361 grenfeilmk lkeslelmel vpqplvdsyr qqqqllqrps hlqppsygpv lspmnkvhgg
421 mnklpsvnql vgqpppHssa atpnlgpvgp gmlnnhghav pangemsssh saqsmvsgsh
481 ctppppyhad pslvrtwgp

SEQ ID NO: 118 Human TP73 transcript variant 9 cDNA sequence
(NM_001204185.2; CDS: 160-1587)
   1 gccctgcctc cccgcccgcg cacccgcccg gaggctcgcg cgcccgcgaa ggggacgcag
  61 cgaaaccggg gcccgcgcca ggccagccgg gacggacgcc gatgcccggg gctgcgacgg
 121 ctgcagagcg agctgccctc ggaggccggc gtggggaaga tggcccagtc caccgccacc
 181 tcccctgatg ggggcaccac gtttgagcac ctctggagct ctctggaacc agacagcacc
 241 tacttcgacc ttccccagtc aagccggggg aataatgagg tggtgggcgg aacggattcc
 301 agcatggacg tcttccacct ggagggcatg actacatctg tcatggccca gttcaatctg
 361 ctgagcagca ccatggacca gatgagcagc cgcgcggcct cggccagccc ctacacccca
 421 gagcacgccg ccagcgtgcc cacccactcg ccctacgcac aacccagctc caccttcgac
 481 accatgtcgc cggcgcctgt catcccctcc aacaccgact accccggacc ccaccacttt
 541 gaggtcactt tccagcagtc cagcacggcc aagtcagcca cctggacgta ctccccgctc
 601 ttgaagaaac tctactgcca gatcgccaag acatgcccca tccagatcaa ggtgtccacc
 661 ccgccacccc caggcaccgc catccgggcc atgcctgttt acaagaaagc ggagcacgtg
 721 accgacgtcg tgaaacgctg ccccaaccac gagctcggga gggacttcaa cgaaggacag
 781 tctgctccag ccagccacct catccgcgtg gaaggcaata atctctcgca gtatgtggat
 841 gaccctgtca ccggcaggca gagcgtcgtg gtgccctatg agccaccaca ggtggggacg
 901 gaattcacca ccatcctgta caacttcatg tgtaacagca gctgtgtagg gggcatgaac
 961 cggcggccca tcctcatcat catcaccctg gagatgcggg atgggcaggt gctgggccgc
1021 cggtcctttg agggccgcat ctgcgcctgt cctggccgcg accgaaaagc tgatgaggac
1081 cactaccggg agcagcaggc cctgaacgag agctccgcca agaacggggc cgccagcaag
1141 cgtgccttca agcagagccc ccctgccgtc cccgcccttg gtgccggtgt gaagaagcgg
1201 cggcatggag acgaggacac gtactacctt caggtgcgag gccgggagaa ctttgagatc
1261 ctgatgaagc tgaaagagag cctggagctg atggagttgg tgccgcagcc actggtggac
1321 tcctatcggc agcagcagca gctcctacag aggccgcccc gggatgctca acaaccatgg
1381 ccacgcagtg ccagccaacg gcgagatgag cagcagccac agcgcccagt ccatggtctc
1441 ggggtcccac tgcactccgc caccccccta ccacgccgac cccagcctcg tcagtttttt
1501 aacaggattg ggtgtccaaa actgcatcga gtatttcacc tcccaagggt tacagagcat
1561 ttaccacctg cagaacctga ccattgagga cctgggggcc ctgaagatcc ccgagcagta
1621 ccgcatgacc atctggcggg gcctgcagga cctgaagcag ggccacgact acagcaccgc
1681 gcagcagctg ctccgctcta gcaacgcggc caccatctcc atcggcggct caggggaact
1741 gcagcgccag cgggtcatgg aggccgtgca cttccgcgtg cgccacacca tcaccatccc
1801 caaccgcggc ggcccaggcg gcggccctga cgagtgggcg gacttcggct tcgacctgcc
1861 cgactgcaag gcccgcaagc agcccatcaa ggaggagttc acggaggccg agatccactg
1921 agggcctcgc ctggctgcag cctgcgccac cgcccagaga cccaagctgc ctcccctctc
1981 cttcctgtgt gtccaaaact gcctcaggag gcaggacctt cgggctgtgc ccggggaaag
2041 gcaaggtccg gcccatcccc aggcacctca caggccccag gaaaggccca gccaccgaag
2101 ccgcctgtgg acagcctgag tcacctgcag aaccttctgg agctgcccta gtgctgggct
2161 tgtggggcgg gggctggccc actctcagcc ctgccactgc ccccggcgtgc tccatggcag
2221 gcgtgggtgg ggaccgcagc gtcggctccg acttccaggc ttcatcctag agactgtcat
2281 ctcccaacca ggcgaggtcc ttccaaagga aaggatcctc tttgctgatg gactgccaaa
2341 aagtattttg cgacatcttt tggttctgga tagtagtgag cagccaagtg actgtgtctg
2401 aaacaccagt gtattttcag ggaatgtccc taactgcgtc ttgcccgcgc cgggggctgg
2461 ggactctctc tgctggactt gggactggcc tctgccccca gcacgctgta ttctgcagga
2521 ccgcctcctt cctgccccta acaacaacca cagtgttgct gaaattggag aaaactgggg
2581 agggcgcaac cccccccagg cgcggggaag catgtggtac cgcctcagcc agtgcccctc
2641 agcctggcca cagtcgcctc tcctcgggga cccctcagca gaaagggaca gcctgtcctt
2701 agaggactgg aaattgtcaa tatttgataa aatgataccc ttttctacat ggtgggtcag
2761 cttttttttt ttttttttta actttctttc tcagcattct ctttggagtt caacctagcg
2821 cccatgagcc aggctgagga agctgagtga gaagccaggt gggcggact tgttcccagg
2881 aaggccgggt ggggaggaag cctagaggga accccaggaa gggcaaatcc aggcaaatct
2941 gcaggaatgc tctgccatgg gagcagctcc tcccttgcca cggccacctt ctctagcact
3001 gcaaggtcca cagggcattg ctttcctttc taggcggtgg cagtcaggga acagactgag
3061 gtaggtgtag gggggtctag gccttcgtgg agcaccccag ggagttagta ggccccgggg
3121 agacagagtc tgcacaggcc ctttctgggg ccacctccat ccacgaggag cagcctgagc
3181 cttggtggcc gaaccttgac cgtcccggag cacagcttca gggcagggaa ccggagcccc
3241 tggggggcct cacgggtgtg acgaggccct tcattgcagg caggtgggcc aatgggagcc
3301 ctcacccacg caagccgaga caccacccag agtgcaggct gcctggcccc ttctggcacg
3361 gccagctcca caccccctgc ctagggtatg tgtggtccta agggctagga gcttccccta
3421 ctaacatctc ccagaaaaag cagttaagcc cctcagggca cagcaaggtt agacacagcc
```

TABLE 1-continued

```
3481 cccatcccca gatcaggact ccatcttgct aagtggcatc accgtcacca gcctcccctt
3541 atttaaaagc agcgactggt gttgccgcag gtacctggtc tacgaagacg caggcatccc
3601 tctcccaccg tccacctccc cgggggccgc tgacagcaca gtcgcctggg tgcacgcttg
3661 tgggggcagc aggaacgggg ctgtcggctc tcaggggatc tggctgcagc cagggcgagg
3721 gcctggccct tccttccagc tccttccggc tccttccagc tgaagggcag gaagctctgg
3781 ccgcttagct tctagggttc catctcccta gaaaggtgcc cacgcccagg gcatcagtca
3841 gtagcggcag cagcagcaga ctcggggctt tcccagggtg gcgcagccac cccagctgca
3901 tgtcacctca gctctccatc ttattgccat tttgtagatg aggaagctga gaccagaaag
3961 gctaagaccc atgccccagg caccacaccc atctcttggg ggctgggcac ctgctacccg
4021 aggccacctc ctgaagcccc cactcttccc ccatgttcca cttcaggagc cgcgggggcc
4081 catcctgaca cccggggttc ctcagcccag cgcagatgtg cttcagttcc agagggcttg
4141 ttgatttgtt tcttaggtac gttacctgtc caccctgagt ccagtgaggc tgtcccaaga
4201 gcccctgtag tgtgctcctg ggaagggctg ggggggctgg gggggctggg agaggcccag
4261 gggcagctgt cactggaacc ccagccagat gtccaaggaa gccggccaga acacggagca
4321 gccagatggc cccagctgca cctgtctagg gagcccatgc agcctccttg cactggagaa
4381 gcagctgtga aagtagacag agttgagact tcgccgtggt caggagaaaa tgcaaattcc
4441 caggaacaag aatcctttaa gtgatatgtt tttataaaac taaacaaatc aacaaataaa
4501 tcttgaaggc ggatggtttt cccagcagtg caggggttgg agggaggctg ctggcactcc
4561 tggggccaag ggggacaggc agtggtcctg agtctgctca gagaggcaag gcagaaggag
4621 ctcgccaggc aggtcagctc acatctgtcc aagtcgctct ggtcagaaac agcgactctc
4681 ccccattccc ccagcgttcc caccaggcct gggctgctgg gaagcccttg ctgtacccag
4741 gagcccgacc cgcagtatcc tggcacagag ccacttgtca ctcagaacag tcagtgtctc
4801 caacgcacaa acatccactc ctctgttacc agttaaagca ctttaatgct ttaaggtgaa
4861 aacgaaatcc catccgtgtt tttcgtgtaa gatcgtgctt ctccgagcag tattaatgga
4921 cgccctccaa tgacataaca actgtttttg gtaatgtaat cttgggaaaa tgtgttattt
4981 ttttagctgt gtttcagtgg ggatttttgt ttttgtaaca taataaagtg tatgttccaa
5041 tga
```

SEQ ID NO: 119 Human TP73 isoform 9 amino acid sequence (NP_001191114.1)

```
  1 maqstatspd ggttfehlws slepdstyfd lpqssrgnne vvggtdssmd vfhlegmtts
 61 vmaqfnllss tmdqmssraa saspytpeha asvpthspya qpsstfdtms papvipsntd
121 ypgphhfevt fqqsstaksa twtyspllkk lycqiaktcp iqikvstppp pgtairampv
181 ykkaehvtdv vkrcpnhelg rdfnegqsap ashlirvegn nlsqyvddpv tgrqsvvvpy
241 eppqvgteft tilynfmcns scvggmnrrp iliiitlemr dgqvlgrrsf egricacpgr
301 drkadedhyr eqqalnessa kngaaskraf kqsppavpal gagvkkrrhg dedtyylqvr
361 grenfeilmk lkeslelmel vpqplvdsyr qqqqllqrpp rdaqqpwprs asqrrdeqqp
421 qrpvhglgvp lhsatpiprr pqprqffnri gvsklhrvfh lprvtehlpp aepdh
```

SEQ ID NO: 120 Human TP73 transcript variant 10 cDNA sequence (NM_001204186.2; CDS: 160-1371)

```
   1 gccctgcctc cccgcccgcg cacccgcccg gaggctcgcg cgcccgcgaa ggggacgcag
  61 cgaaaccggg gcccgcgcca ggccagccgg gacggacgcc gatgcccggg gctgcgacgg
 121 ctgcagagcg agctgccctc ggaggccggc gtggggaaga tggcccagtc caccgccacc
 181 tcccctgatg ggggcaccac gtttgagcac ctctggagct ctctggaacc agacagcacc
 241 tacttcgacc ttccccagtc aagccggggg aataatgagg tggtgggcgg aacggattcc
 301 agcatggacg tcttccacct ggagggcatg actacatctg tcatggccca gttcaatctg
 361 ctgagcagca ccatggacca gatgagcagc cgcgcggcct cggccagccc ctacacccca
 421 gagcacgccg ccagcgtgcc cacccactcg ccctacgcac aacccagctc caccttcgac
 481 accatgtcgc cggcgcctgt catcccctcc aacaccgact accccggacc ccaccacttt
 541 gaggtcactt tccagcagtc cagcacggcc aagtcagcca cctggacgta ctccccgctc
 601 ttgaagaaac tctactgcca gatcgccaag acatgcccca tccagatcaa ggtgtccacc
 661 ccgccaccccc caggcaccgc catccgggcc atgcctgttt acaagaaagc ggagcacgtg
 721 accgacgtcg tgaaacgctg ccccaaccac gagctcggga gggacttcaa cgaaggacag
 781 tctgctccag ccagccacct catccgcgtg gaaggcaata atctctcgca gtatgtggat
 841 gaccctgtca ccggcaggca gagcgtcgtg gtgccctatg agccaccaca ggtggggacg
 901 gaattcacca ccatcctgta caacttcatg tgtaacagca gctgtgtagg gggcatgaac
 961 cggcggccca tcctcatcat catcaccctg gagatgcggg atgggcaggt gctgggccgc
1021 cggtcctttg agggccgcat ctgcgcctgt cctggccgcg accgaaaagc tgatgaggac
1081 cactaccggg agcagcaggc cctgaacgag agctccgcca agaacggggc cgccagcaag
1141 cgtgccttca agcagagccc ccctgccgtc cccgcccttg gtgccggtgt gaagaagcgg
1201 cggcatggag acgaggacac gtactacctt caggtgcgag gccgggagaa ctttgagatc
1261 ctgatgaagc tgaaagagag cctggagctg atggagttgg tgccgcagcc actggtggac
1321 tcctatcggc agcagcagca gctcctacag aggccgacct gggggccctg aagatccccg
1381 agcagtaccg catgaccatc tggcggggcc tgcaggacct gaagcagggc cacgactaca
1441 gcaccgcgca gcagctgctc cgctctagca acgcggccac catctccatc ggcggctcag
1501 gggaactgca gcgccagcgg gtcatggagg ccgtgcactt ccgcgtgcgc cacaccatca
1561 ccatccccaa ccgcggcggc ccaggcggcg gccctgacga gtgggcggac ttcggcttcg
1621 acctgcccga ctgcaaggcc cgcaagcagc ccatcaagga ggagttcacg gaggccgaga
1681 tccactgagg gcctcgcctg gctgcagcct gcgccaccgc ccagagaccc aagctgcctc
1741 ccctctcctt cctgtgtgtc caaaactgcc tcaggaggca ggaccttcgg gctgtgcccg
1801 gggaaaggca aggtccggcc catccccagg cacctcacag gccccaggaa aggcccagcc
1861 accgaagccg cctgtggaca gcctgagtca cctgcagaac cttctggagc tgccctagtg
1921 ctgggcttgt ggggcggggg ctggcccact ctcagccctg ccactgcccc ggcgtgctcc
1981 atggcaggcg tgggtgggga ccgcagcgtc ggctccgact tccaggcttc atcctagaga
2041 ctgtcatctc ccaaccaggc gaggtccttc caaaggaaag gatcctcttt gctgatggac
2101 tgccaaaaag tattttgcga catcttttgg ttctggatag tagtgagcag ccaagtgact
2161 gtgtctgaaa caccagtgta ttttcaggga atgtccctaa ctgcgtcttg cccgcgccgg
2221 gggctgggga ctctctctgc tggacttggg actggcctct gcccccagca cgctgtattc
2281 tgcaggaccg cctccttcct gccctaaca acaaccacag tgttgctgaa attggagaaa
2341 actggggagg gcgcaacccc ccccaggcgc ggggaagcat gtggtaccgc ctcagccagt
```

TABLE 1-continued

```
2401 gcccctcagc ctggccacag tcgcctctcc tcggggaccc ctcagcagaa agggacagcc
2461 tgtccttaga ggactggaaa ttgtcaatat ttgataaaat gatacccttt tctacatggt
2521 gggtcagctt tttttttttt tttttaact ttctttctca gcattctctt tggagttcaa
2581 cctagcgccc atgagccagg ctgaggaagc tgagtgagaa gccaggtggg cgggacttgt
2641 tcccaggaag gccgggtggg gaggaagcct agagggaacc ccaggaaggg caaatccagg
2701 caaatctgca ggaatgctct gccatgggag cagctcctcc cttgccacgg ccaccttctc
2761 tagcactgca aggtccacag ggcattgctt tcctttctag gcggtggcag tcagggaaca
2821 gactgaggta ggtgtagggg ggtctaggcc ttcgtggagc accccaggga gttagtaggc
2881 cccggggaga cagagtctgc acaggccctt tctggggcca cctccatcca cgaggagcag
2941 cctgagcctt ggtggccgaa ccttgaccgt cccggagcac agcttcaggg cagggaaccg
3001 gagcccctgg ggggcctcac gggtgtgacg aggcccttca ttgcaggcag gtgggccaat
3061 gggagccctc acccacgcaa gccgagacac cacccagagt gcaggctgcc tggccccttc
3121 tggcacggcc agctccacac cccctgccta gggtatgtgt ggtcctaagg gctaggagct
3181 tcccctacta acatctccca gaaaaagcag ttaagcccct cagggcacag caaggttaga
3241 cacagccccc atccccagat caggactcca tcttgctaag tggcatcacc gtcaccagcc
3301 tccccttatt taaaagcagc gactggtgtt gccgcaggta cctggtctac gaagacgcag
3361 gcatccctct cccaccgtcc acctccccgg gggccgctga cagcacagtc gcctgggtgc
3421 acgcttgtgg gggcagcagg aacggggctg tcggctctca ggggatctgg ctgcagccag
3481 ggcgagggcc tggcccttcc ttccagctcc ttccggctcc ttccagctga agggcaggaa
3541 gctctggccg cttagcttct agggttccat ctccctagaa aggtgcccac gcccagggca
3601 tcagtcagta gcggcagcag cagcagactc ggggctttcc cagggtggcg cagccacccc
3661 agctgcatgt cacctcagct ctccatctta ttgccatttt gtagatgagg aagctgagac
3721 cagaaaggct aagacccatg ccccaggcac cacacccatc tcttggggc tgggcacctg
3781 ctacccgagg ccacctcctg aagcccccac tcttccccca tgttccactt caggagccgc
3841 gggggcccat cctgacaccc ggggttcctc agcccagcgc agatgtgctt cagttccaga
3901 gggcttgttg atttgtttct taggtacgtt acctgtccac cctgagtcca gtgaggctgt
3961 cccaagagcc cctgtagtgt gctcctggga agggctgggg gggctggggg ggctgggaga
4021 ggcccagggg cagctgtcac tggaacccca gccagatgtc caaggaagcc ggccagaaca
4081 cggagcagcc agatggcccc agctgcacct gtctagggag cccatgcagc ctccttgcac
4141 tggagaagca gctgtgaaag tagacagagt tgagacttcg ccgtggtcag gagaaaatgc
4201 aaattcccag gaacaagaat cctttaagtg atatgttttt ataaaactaa acaaatcaac
4261 aaataaatct tgaaggcgga tggttttccc agcagtgcag gggttggagg gaggctgctg
4321 gcactcctgg ggccaagggg gacaggcagt ggtcctgagt ctgctcagag aggcaaggca
4381 gaaggagctc gccaggcagg tcagctcaca tctgtccaag tcgctctggt cagaaacagc
4441 gactctcccc cattccccca gcgttcccac caggcctggg ctgctgggaa gcccttgctg
4501 tacccaggag cccgacccgc agtatcctgg cacagagcca cttgtcactc agaacagtca
4561 gtgtctccaa cgcacaaaca tccactcctc tgttaccagt taaagcactt taatgcttta
4621 aggtgaaaac gaaatcccat ccgtgttttt cgtgtaagat cgtgcttctc cgagcagtat
4681 taatggacgc cctccaatga cataacaact gtttttggta atgtaatctt gggaaaatgt
4741 gttatttttt tagctgtgtt tcagtgggga tttttgtttt tgtaacataa taaagtgtat
4801 gttccaatga
```

SEQ ID NO: 121 Human TP73 isoform 10 amino acid sequence (NP_001191115.1)

```
  1 maqstatspd ggttfehlws slepdstyfd lpqssrgnne vvggtdssmd vfhlegmtts
 61 vmaqfnllss tmdqmssraa saspytpeha asvpthspya qpsstfdtms papvipsntd
121 ypgphhfevt fqqsstaksa twtyspllkk lycqiaktcp iqikvstppp pgtairampv
181 ykkaehvtdv vkrcpnhelg rdfnegqsap ashlirvegn nlsqyvddpv tgrqsvvvpy
241 eppqvgteft tilynfmcns scvggmnrrp iliiitlemr dgqvlgrrsf egricacpgr
301 drkadedhyr eqqalnessa kngaaskraf kqsppavpal gagvkkrrhg dedtyylqvr
361 grenfeilmk lkeslelmel vpqplvdsyr qqqqllqrpt wgp
```

SEQ ID NO: 122 Human TP73 transcript variant 11 cDNA sequence (NM_001204187.1; CDS: NP_001191116.1)

```
  1 maqstatspd ggttfehlws slepdstyfd lpqssrgnne vvggtdssmd vfhlegmtts
 61 vmaqfnllss tmdqmssraa saspytpeha asvpthspya qpsstfdtms papvipsntd
121 ypgphhfevt fqqsstaksa twtyspllkk lycqiaktcp iqikvstppp pgtairampv
181 ykkaehvtdv vkrcpnhelg rdfnegqsap ashlirvegn nlsqyvddpv tgrqsvvvpy
241 eppqvgteft tilynfmcns scvggmnrrp iliiitlemr dgqvlgrrsf egricacpgr
301 drkadedhyr eqqalnessa kngaaskraf kqsppavpal gagvkkrrhg dedtyylqvr
361 grenfeilmk lkeslelmel vpqplvdsyr qqqqllqrpp rdaqqpwprs asqrrdeqqp
421 qrpvhglgvp lhsatplprr pqprqdlgal kipeqyrmti wrglqdlkqg hdystaqqll
481 rssnaatisi ggsgelqrqr vmeavhfrvr htitipnrgg pgggpdewad fgfdlpdcka
541 rkqpikeeft eaeih
```

SEQ ID NO: 123 Human TP73 isoform 11 amino acid sequence (NP_001191116.1)

```
  1 maqstatspd ggttfehlws slepdstyfd lpqssrgnne vvggtdssmd vfhlegmtts
 61 vmaqfnllss tmdqmssraa saspytpeha asvpthspya qpsstfdtms papvipsntd
121 ypgphhfevt fqqsstaksa twtyspllkk lycqiaktcp iqikvstppp pgtairampv
181 ykkaehvtdv vkrcpnhelg rdfnegqsap ashlirvegn nlsqyvddpv tgrqsvvvpy
241 eppqvgteft tilynfmcns scvggmnrrp iliiitlemr dgqvlgrrsf egricacpgr
301 drkadedhyr eqqalnessa kngaaskraf kqsppavpal gagvkkrrhg dedtyylqvr
361 grenfeilmk lkeslelmel vpqplvdsyr qqqqllqrpp rdaqqpwprs asqrrdeqqp
421 qrpvhglgvp lhsatplprr pqprqdlgal kipeqyrmti wrglqdlkqg hdystaqqll
481 rssnaatisi ggsgelqrqr vmeavhfrvr htitipnrgg pgggpdewad fgfdlpdcka
541 rkqpikeeft eaeih
```

SEQ ID NO: 124 Human TP73 transcript variant 12 cDNA sequence (NM_001204188.1; CDS: 111-1733)

```
  1 aggggacgca gcgaaaccgg ggcccgcgcc aggccagccg ggacggacgc cgatgcccgg
 61 ggctgcgacg gctgcagagc gagctgccct cggaggccgg cgtggggaag atggcccagt
```

TABLE 1-continued

| | | | | | | |
|---|---|---|---|---|---|---|
| 121 | ccaccgccac | ctcccctgat | gggggcacca | cgtttgagca | cctctggagc | tctctggaac |
| 181 | cagacagcac | ctacttcgac | cttccccagt | caagccgggg | gaataatgag | gtggtgggcg |
| 241 | gaacggattc | cagcatggac | gtcttccacc | tggagggcat | gactacatct | gtcatggccc |
| 301 | agttcaatct | gctgagcagc | accatggacc | agatgagcag | ccgcgcggcc | tcggccagcc |
| 361 | cctacacccc | agagcacgcc | gccagcgtgc | ccacccactc | gccctacgca | caacccagct |
| 421 | ccaccttcga | caccatgtcg | ccggcgcctg | tcatcccctc | caacaccgac | taccccggac |
| 481 | cccaccactt | tgaggtcact | ttccagcagt | ccagcacggc | caagtcagcc | acctggacgt |
| 541 | actccccgct | cttgaagaaa | ctctactgcc | agatcgccaa | gacatgcccc | atccagatca |
| 601 | aggtgtccac | cccgccaccc | ccaggcaccg | ccatccgggc | catgcctgtt | tacaagaaag |
| 661 | cggagcacgt | gaccgacgtc | gtgaaacgct | gccccaacca | cgagctcggg | agggacttca |
| 721 | acgaaggaca | gtctgctcca | gccagccacc | tcatccgcgt | ggaaggcaat | aatctctcgc |
| 781 | agtatgtgga | tgaccctgtc | accggcaggc | agagcgtcgt | ggtgccctat | gagccaccac |
| 841 | aggtggggac | ggaattcacc | accatcctgt | acaacttcat | gtgtaacagc | agctgtgtag |
| 901 | ggggcatgaa | ccggcggccc | atcctcatca | tcatcaccct | ggagatgcgg | gatgggcagg |
| 961 | tgctgggccg | ccggtccttt | gagggccgca | tctgcgcctg | tcctggccgc | gaccgaaaag |
| 1021 | ctgatgagga | ccactaccgg | gagcagcagg | ccctgaacga | gagctccgcc | aagaacgggg |
| 1081 | ccgccagcaa | gcgtgccttc | aagcagagcc | cccctgccgt | ccccgccctt | ggtgccggtg |
| 1141 | tgaagaagcg | gcggcatgga | gacgaggaca | cgtactacct | tcaggtgcga | ggccgggaga |
| 1201 | actttgagat | cctgatgaag | ctgaaagaga | gcctggagct | gatggagttg | gtgccgcagc |
| 1261 | cactggtgga | ctcctatcgg | cagcagcagc | agctcctaca | gaggcctttt | ttaacaggat |
| 1321 | tggggtgtcc | aaactgcatc | gagtatttca | cctcccaagg | gttacagagc | atttaccacc |
| 1381 | tgcagaacct | gaccattgag | gacctggggg | ccctgaagat | ccccgagcag | taccgcatga |
| 1441 | ccatctggcg | gggcctgcag | gacctgaagc | agggccacga | ctacagcacc | gcgcagcagc |
| 1501 | tgctccgctc | tagcaacgcg | gccaccatct | ccatcggcgg | ctcaggggaa | ctgcagcgcc |
| 1561 | agcgggtcat | ggaggccgtg | cacttccgcg | tgcgccacac | catcaccatc | cccaaccgcg |
| 1621 | gcggcccagg | cggcggccct | gacgagtggg | cggacttcgg | cttcgacctg | cccgactgca |
| 1681 | aggcccgcaa | gcagcccatc | aaggaggagt | tcacggaggc | cgagatccac | tgagggcctc |
| 1741 | gcctggctgc | agcctgcgcc | accgcccaga | gacccaagct | gcctcccctc | tccttcctgt |
| 1801 | gtgtccaaaa | ctgcctcagg | aggcaggacc | ttcgggctgt | gcccggggaa | aggcaaggtc |
| 1861 | cggcccatcc | ccaggcacct | cacaggcccc | aggaaaggcc | cagccaccga | agccgcctgt |
| 1921 | ggacagcctg | agtcacctgc | agaaccttct | ggagctgccc | tagtgctggg | cttgtggggc |
| 1981 | gggggctggc | ccactctcag | ccctgccact | gccccggcgt | gctccatggc | aggcgtgggt |
| 2041 | ggggaccgca | gcgtcggctc | cgacttccag | gcttcatcct | agagactgtc | atctcccaac |
| 2101 | caggcgaggt | ccttccaaag | gaaaggatcc | tctttgctga | tggactgcca | aaaagtattt |
| 2161 | tgcgacatct | tttggttctg | gatagtagtg | agcagccaag | tgactgtgtc | tgaaacacca |
| 2221 | gtgtattttc | agggaatgtc | cctaactgcg | tcttgcccgc | gccgggggct | ggggactctc |
| 2281 | tctgctggac | ttgggactgg | cctctgcccc | cagcacgctg | tattctgcag | gaccgcctcc |
| 2341 | ttcctgcccc | taacaacaac | cacagtgttg | ctgaaattgg | agaaaactgg | ggagggcgca |
| 2401 | accccccccca | ggcgcgggga | agcatgtggt | accgcctcag | ccagtgcccc | tcagcctggc |
| 2461 | cacagtcgcc | tctcctcggg | gacccctcag | cagaaaggga | cagcctgtcc | ttagaggact |
| 2521 | ggaaattgtc | aatatttgat | aaaatgatac | ccttttctac | atggtgggtc | agcttttttt |
| 2581 | tttttttttt | taactttctt | tctcagcatt | ctctttggag | ttcaacctag | cgcccatgag |
| 2641 | ccaggctgag | gaagctgagt | gagaagccag | gtgggcggga | cttgttccca | ggaaggccgg |
| 2701 | gtggggagga | agcctagagg | gaaccccagg | aagggcaaat | ccaggcaaat | ctgcaggaat |
| 2761 | gctctgccat | gggagcagct | cctcccttgc | cacggccacc | ttctctagca | ctgcaaggtc |
| 2821 | cacagggcat | tgctttcctt | tctaggcggt | ggcagtcagg | gaacagactg | aggtaggtgt |
| 2881 | agggggggtct | aggccttcgt | ggagcacccc | agggagttag | taggccccgg | ggagacagag |
| 2941 | tctgcacagg | ccctttctgg | ggccacctcc | atccacgagg | agcagcctga | gccttggtgg |
| 3001 | ccgaaccttg | accgtcccgg | agcacagctt | cagggcaggg | aaccggagcc | cctgggggggc |
| 3061 | ctcacgggtg | tgacgaggcc | cttcattgca | ggcaggtggg | ccaatgggag | ccctcaccca |
| 3121 | cgcaagccga | gacaccaccc | agagtgcagg | ctgcctggcc | ccttctggca | cggccagctc |
| 3181 | cacacccccct | gcctagggta | tgtgtggtcc | taagggctag | gagcttcccc | tactaacatc |
| 3241 | tcccagaaaa | agcagttaag | cccctcaggg | cacagcaagg | ttagacacag | cccccatccc |
| 3301 | cagatcagga | ctccatcttg | ctaagtggca | tcaccgtcac | cagcctcccc | ttatttaaaa |
| 3361 | gcagcgactg | gtgttgccgc | aggtacctgg | tctacgaaga | cgcaggcatc | cctctcccac |
| 3421 | cgtccacctc | cccgggggcc | gctgacagca | cagtcgcctg | ggtgcacgct | tgtgggggca |
| 3481 | gcaggaacgg | ggctgtcggc | tctcagggga | tctggctgca | gccagggcga | gggcctggcc |
| 3541 | cttccttcca | gctccttccg | gctccttcca | gctgaagggc | aggaagctct | ggccgcttag |
| 3601 | cttctagggt | tccatctccc | tagaaaggtg | cccacgccca | gggcatcagt | cagtagcggc |
| 3661 | agcagcagca | gactcggggc | tttcccaggg | tggcgcagcc | accccagctg | catgtcacct |
| 3721 | cagctctcca | tcttattgcc | attttgtaga | tgaggaagct | gagaccagaa | aggctaagac |
| 3781 | ccatgcccca | ggcaccacac | ccatctcttg | gggctgggc | acctgctacc | cgaggccacc |
| 3841 | tcctgaagcc | cccactcttc | ccccatgttc | cacttcagga | gccgcggggg | cccatcctga |
| 3901 | cacccggggt | tcctcagccc | agcgcagatg | tgcttcagtt | ccagagggct | tgttgatttg |
| 3961 | tttcttaggt | acgttacctg | tccaccctga | gtccagtgag | gctgtcccaa | gagcccctgt |
| 4021 | agtgtgctcc | tgggaagggc | tgggggggct | ggggggggctg | ggagaggccc | aggggcagct |
| 4081 | gtcactggaa | ccccagccag | atgtccaagg | aagccggcca | gaacacggag | cagccagatg |
| 4141 | gccccagctg | cacctgtcta | gggagcccat | gcagcctcct | tgcactggag | aagcagctgt |
| 4201 | gaaagtagac | agagttgaga | cttcgccgtg | gtcaggagaa | aatgcaaatt | cccaggaaca |
| 4261 | agaatccttt | aagtgatatg | tttttataaa | actaaacaaa | tcaacaaata | aatcttgaag |
| 4321 | gcggatggtt | ttcccagcag | tgcaggggtt | ggagggaggc | tgctggcact | cctggggcca |
| 4381 | agggggacag | gcagtggtcc | tgagtctgct | cagagaggca | aggcagaagg | agctcgccag |
| 4441 | gcaggtcagc | tcacatctgt | ccaagtcgct | ctggtcagaa | acagcgactc | tcccccattc |
| 4501 | ccccagcgtt | cccaccaggc | ctgggctgct | gggaagccct | tgctgtaccc | aggagcccga |
| 4561 | cccgcagtat | cctggcacag | agccacttgt | cactcagaac | agtcagtgtc | tccaacgcac |
| 4621 | aaacatccac | tcctctgtta | ccagttaaag | cactttaatg | ctttaaggtg | aaaacgaaat |
| 4681 | cccatccgtg | tttttcgtgt | aagatcgtgc | ttctccgagc | agtattaatg | gacgccctcc |
| 4741 | aatgacataa | caactgtttt | tggtaatgta | atcttgggaa | aatgtgttat | ttttttagct |
| 4801 | gtgtttcagt | ggggattttt | gtttttgtaa | cataataaag | tgtatgttcc | aatgaaaaaa |
| 4861 | aaaaaa | | | | | |

TABLE 1-continued

SEQ ID NO: 125 Human TP73 isoform 12 amino acid sequence (NP_001191117.1)
```
    1 maqstatspd ggttfehlws slepdstyfd lpqssrgnne vvggtdssmd vfhlegmtts
   61 vmaqfnllss tmdqmssraa saspytpeha asvpthspya qpsstfdtms papvipsntd
  121 ypgphhfevt fqqsstaksa twtyspllkk lycqiaktcp iqikvstppp pgtairampv
  181 ykkaehvtdv vkrcpnhelg rdfnegqsap ashlirvegn nlsqyvddpv tgrqsvvvpy
  241 eppqvgteft tilynfmcns scvggmnrrp iliiitlemr dgqvlgrrsf egricacpgr
  301 drkadedhyr eqqalnessa kngaaskraf kqsppavpal gagvkkrrhg dedtyylqvr
  361 grenfeilmk lkeslelmel vpqplvdsyr qqqllqrpf ltglgcpnci eyftsqglqs
  421 iyhlqnltie dlgalkipeq yrmtiwrglq dlkqghdyst aqqllrssna atisiggsge
  481 lqrqrvmeav hfrvrhtiti pnrggpgggp dewadfgfdl pdckarkqpi keefteaeih
```

SEQ ID NO: 126 Human TP73 transcript variant 13 cDNA sequence
(NM_001204192.2; CDS: 134-1831)
```
    1 aatgtgtgct ggaaggtgtc caggaagccc tgctaagcat ctgtcagtgt ctccagcaca
   61 gcaggaggct gttacaggtg gcgcctgatt cacatctgca ggacaggccc agttcaatct
  121 gctgagcagc accatggacc agatgagcag ccgcgcggcc tcggccagcc cctacacccc
  181 agagcacgcc gccagcgtgc ccacccactc gccctacgca caacccagct ccaccttcga
  241 caccatgtcg ccggcgcctg tcatcccctc caacaccgac taccccggac cccaccactt
  301 tgaggtcact ttccagcagt ccagcacggc caagtcagcc acctggacgt actccccgct
  361 cttgaagaaa ctctactgcc agatcgccaa gacatgcccc atccagatca aggtgtccac
  421 cccgccaccc ccaggcaccg ccatccgggc catgcctgtt tacaagaaag cggagcacgt
  481 gaccgacgtc gtgaaacgct gccccaacca cgagctcggg agggacttca acgaaggaca
  541 gtctgctcca gccagccacc tcatccgcgt ggaaggcaat aatctctcgc agtatgtgga
  601 tgaccctgtc accggcaggc agagcgtcgt ggtgccctat gagccaccac aggtggggac
  661 ggaattcacc accatcctgt acaacttcat gtgtaacagc agctgtgtag gggcatgaa
  721 ccggcggccc atcctcatca tcatcaccct ggagatgcgg gatgggcagg tgctgggccg
  781 ccggtccttt gagggccgca tctgcgcctg tcctggccgc gaccgaaaag ctgatgagga
  841 ccactaccgg gagcagcagg ccctgaacga gagctccgcc aagaacgggg ccgccagcaa
  901 gcgtgccttc aagcagagcc cccctgccgt ccccgccctt ggtgccggtg tgaagaagcg
  961 gcggcatgga gacgaggaca cgtactacct tcaggtgcga ggccgggaga actttgagat
 1021 cctgatgaag ctgaaagaga gcctggagct gatggagttg gtgccgcagc cactggtgga
 1081 ctcctatcgg cagcagcagc agctcctaca gaggccgagt cacctacagc ccccgtccta
 1141 cgggccggtc ctctcgccca tgaacaaggt gcacgggggc atgaacaagc tgccctccgt
 1201 caaccagctg gtgggccagc ctcccccgca cagttcggca gctacaccca acctggggcc
 1261 cgtgggcccc gggatgctca acaaccatgg ccacgcagtg ccagccaacg gcgagatgag
 1321 cagcagccac agcgcccagt ccatggtctc ggggtcccac tgcactccgc caccccccta
 1381 ccacgccgac cccagcctcg tcagtttttt aacaggattg ggtgtccaa actgcatcga
 1441 gtatttcacc tcccaagggt tacagagcat ttaccacctg cagaacctga ccattgagga
 1501 cctgggggcc ctgaagatcc ccgagcagta ccgcatgacc atctggcggg gcctgcagga
 1561 cctgaagcag ggccacgact acagcaccgc gcagcagctg ctccgctcta gcaacgcggc
 1621 caccatctcc atcggcggct caggggaact gcagcgccag cgggtcatgg aggccgtgca
 1681 cttccgcgtg cgccacacca tcaccatccc caaccgcggc ggcccaggcg gcggccctga
 1741 cgagtgggcg gacttcggct tcgacctgcc cgactgcaag gcccgcaagc agcccatcaa
 1801 ggaggagttc acggaggccg agatccactg agggcctcgc ctggctgcag cctgcgccac
 1861 cgcccagaga cccaagctgc ctcccctctc cttcctgtgt gtccaaaact gcctcaggag
 1921 gcaggacctt cgggctgtgc ccggggaaag gcaaggtccg gcccatcccc aggcacctca
 1981 caggccccag gaaaggccca gccaccgaag ccgcctgtgg acagcctgag tcacctgcag
 2041 aaccttctgg agctgcccta gtgctgggct tgtggggcgg gggctggccc actctcagcc
 2101 ctgccactgc cccggcgtgc tccatggcag gcgtgggtgg ggaccgcagc gtcggctccg
 2161 acttccaggc ttcatcctag agactgtcat ctcccaacca ggcgaggtcc ttccaaagga
 2221 aaggatcctc tttgctgatg gactgccaaa aagtattttg cgacatcttt tggttctgga
 2281 tagtagtgag cagccaagtg actgtgtctg aaacaccagt gtattttcag ggaatgtccc
 2341 taactgcgtc ttgcccgcgc cgggggctgg ggactctctc tgctggactt gggactggcc
 2401 tctgccccca gcacgctgta ttctgcagga ccgcctcctt cctgccccta acaacaacca
 2461 cagtgttgct gaaattggag aaaactgggg agggcgcaac cccccccagg cgcggggaag
 2521 catgtggtac cgcctcagcc agtgcccctc agcctggcca cagtcgcctc tcctcgggga
 2581 cccctcagca gaaagggaca gcctgtcctt agaggactgg aaattgtcaa tatttgataa
 2641 aatgataccc ttttctacat ggtgggtcag cttttttttt ttttttttta actttctttc
 2701 tcagcattct ctttggagtt caacctagcg cccatgagcc aggctgagga agctgagtga
 2761 gaagccaggt gggcgggact tgttcccagg aaggccgggt ggggaggaag cctagaggga
 2821 accccaggaa gggcaaatcc aggcaaatct gcaggaatgc tctgccatgg gagcagctcc
 2881 tcccttgcca cggccacctt ctctagcact gcaaggtcca cagggcattg ctttcctttc
 2941 taggcggtgg cagtcaggga acagactgag gtaggtgtag gggggtctag gccttcgtgg
 3001 agcaccccag ggagttagta ggccccgggg agacagagtc tgcacaggcc ctttctgggg
 3061 ccacctccat ccacgaggag cagcctgagc cttggtggcc gaaccttgac cgtcccggag
 3121 cacagcttca gggcagggaa ccggagcccc tgggggcct cacgggtgtg acgaggccct
 3181 tcattgcagg caggtgggcc aatgggagcc ctcacccacg caagccgaga caccacccag
 3241 agtgcaggct gcctggcccc ttctggcacg gccagctcca caccccctgc ctagggtatg
 3301 tgtggtccta agggctagga gcttccccta ctaacatctc ccagaaaaag cagttaagcc
 3361 cctcagggca cagcaaggtt agacacagcc cccatcccca gatcaggact ccatcttgct
 3421 aagtggcatc accgtcacca gcctcccctt atttaaaagc agcgactggt gttgccgcag
 3481 gtacctggtc tacgaagacg caggcatccc tctcccaccg tccacctccc cgggggccgc
 3541 tgacagcaca gtcgcctggg tgcacgcttg tgggggcagc aggaacgggg ctgtcggctc
 3601 tcaggggatc tggctgcagc cagggcgagg gcctggccct tccttccagc tccttccggc
 3661 tccttccagc tgaagggcag gaagctctgg ccgcttagct tctagggttc catctcccta
 3721 gaaaggtgcc cacgcccagg gcatcagtca gtagaggcag cagcagcaga ctaggggctt
 3781 tcccagggtg gcgcagccac cccagctgca tgtcacctca gctctccatc ttattgccat
 3841 tttgtagatg aggaagctga gaccagaaag gctaagaccc atgccccagg caccacaccc
 3901 atctcttggg ggctgggcac ctgctacccg aggccacctc ctgaagcccc cactcttccc
```

TABLE 1-continued

```
3961 ccatgttcca cttcaggagc cgcgggggcc catcctgaca cccggggttc ctcagcccag
4021 cgcagatgtg cttcagttcc agagggcttg ttgatttgtt tcttaggtac gttacctgtc
4081 caccctgagt ccagtgaggc tgtcccaaga gcccctgtag tgtgctcctg ggaagggctg
4141 ggggggctgg gggggctggg agaggcccag gggcagctgt cactggaacc ccagccagat
4201 gtccaaggaa gccggccaga acacggagca gccagatggc cccagctgca cctgtctagg
4261 gagcccatgc agcctccttg cactggagaa gcagctgtga aagtagacag agttgagact
4321 tcgccgtggt caggagaaaa tgcaaattcc caggaacaag aatcctttaa gtgatatgtt
4381 tttataaaac taaacaaatc aacaaataaa tcttgaaggc ggatggtttt cccagcagtg
4441 caggggttgg agggaggctg ctggcactcc tggggccaag ggggacaggc agtggtcctg
4501 agtctgctca gagaggcaag gcagaaggag ctcgccaggc aggtcagctc acatctgtcc
4561 aagtcgctct ggtcagaaac agcgactctc ccccattccc ccagcgttcc caccaggcct
4621 gggctgctgg gaagcccttg ctgtacccag gagcccgacc cgcagtatcc tggcacagag
4681 ccacttgtca ctcagaacag tcagtgtctc caacgcacaa acatccactc ctctgttacc
4741 agttaaagca ctttaatgct ttaaggtgaa aacgaaatcc catccgtgtt tttcgtgtaa
4801 gatcgtgctt ctccgagcag tattaatgga cgccctccaa tgacataaca actgtttttg
4861 gtaatgtaat cttgggaaaa tgtgttattt ttttagctgt gtttcagtgg ggatttttgt
4921 ttttgtaaca taataaagtg tatgttccaa tga
```

SEQ ID NO: 127 Human TP73 isoform 13 amino acid sequence (NP_001191121.1)

```
  1 mdqmssraas aspytpehaa svpthspyaq psstfdtmsp apvipsntdy pgphhfevtf
 61 qqsstaksat wtyspllkkl ycqiaktcpi qikvstpppp gtairampvy kkaehvtdvv
121 krcpnhelgr dfnegqsapa shlirvegnn lsqyvddpvt grqsvvvpye ppqvgteftt
181 ilynfmcnss cvggmnrrpi liiitlemrd gqvlgrrsfe gricacpgrd rkadedhyre
241 qqalnessak ngaaskrafk qsppavpalg agvkkrrhgd edtyylqvrg renfeilmkl
301 keslelmelv pqplvdsyrq qqqllqrpsh lqppsygpvl spmnkvhggm nklpsvnqlv
361 gqpppphssaa tpnlgpvgpg mlnnhghavp angemssshs aqsmvsgshc tppppyhadp
421 slvsfltglg cpncieyfts qglqsiyhlq nitiedlgal kipeqyrmti wrglqdlkqg
481 hdystaqqll rssnaatisi ggsgelqrqr vmeavhfrvr htitipnrgg pgggpdewad
541 fgfdlpdcka rkqpikeeft eaeih
```

SEQ ID NO: 128 Mouse TP73 transcript variant 1 cDNA sequence (NM_011642.4; CDS: 76-1971)

```
   1 gaggcaacgc tgcagcccag ccctcgccga cgccgacgcc cggcccggag cagaatgagc
  61 ggcagcgttg gggagatggc ccagacctct tcttcctcct cctccacctt cgagcacctg
 121 tggagttctc tagagccaga cagcacctac tttgacctcc cccagcccag ccaagggact
 181 agcgaggcat caggcagcga ggagtccaac atggatgtct tccacctgca aggcatggcc
 241 cagttcaatt tgctcagcag tgccatggac cagatgggca gccgtgcggc cccggcgagc
 301 ccctacaccc cggagcacgc cgccagcgcg cccacccact cgccctacgc gcagcccagc
 361 tccaccttcg acaccatgtc tccggcgcct gtcatccctt ccaataccga ctaccccggc
 421 ccccaccact tcgaggtcac cttccagcag tcgagcactg ccaagtcggc cacctggaca
 481 tactccccac tcttgaagaa gttgtactgt cagattgcta agacatgccc catccagatc
 541 aaagtgtcca caccaccacc cccgggcacg gccatccggg ccatgcctgt ctacaagaag
 601 gcagagcatg tgaccgacat tgttaagcgc tgccccaacc acgagcttgg aagggacttc
 661 aatgaaggac agtctgcccc ggctagccac ctcatccgtg tagaaggcaa caacctcgcc
 721 cagtacgtgg atgaccctgt caccggaagg cagagtgtgg ttgtgccgta tgaaccccca
 781 caggtgggaa cagaatttac caccatcctg tacaacttca tgtgtaacag cagctgtgtg
 841 gggggcatga ataggaggcc catccttgtc atcatcaccc tggagacccg ggatggacag
 901 gtcctgggcc gccggtcttt cgagggtcgc atctgtgcct gtcctggccg tgaccgcaaa
 961 gctgatgaag accattaccg ggagcaacag gctctgaatg aaagtaccac caaaaatgga
1021 gctgccagca aacgtgcatt caagcagagc ccccctgcca tccctgccct gggtaccaac
1081 gtgaagaaga gacgccacgg ggacgaggac atgttctaca tgcacgtgcg aggccgggag
1141 aactttgaga tcttgatgaa agtcaaggag agcctagaac tgatggagct tgtgccccag
1201 cctttggttg actcctatcg acagcagcag cagcagcagc tcctacagag gccgagtcac
1261 ctgcagcctc catcctatgg gcccgtgctc tccccaatga acaaggtaca cggtggtgtc
1321 aacaaactgc cctccgtcaa ccagctggtg ggccagcctc ccccgcacag ctcagcagct
1381 gggcccaacc tggggcccat gggctccggg atgctcaaca gccacggcca cagcatgccg
1441 gccaatggtg agatgaatgg aggccacagc tcccagacca tggtttcggg atcccactgc
1501 accccgccac cccctatca tgcagacccc agcctcgtca gtttttgac agggttgggg
1561 tgtccaaact gcatcgagtg cttcacttcc caagggttgc agagcatcta ccacctgcag
1621 aaccttacca tcgaggacct tggggctctg aaggtccctg accagtaccg tatgaccatc
1681 tggaggggcc tacaggacct gaagcagagc catgactgcg gccagcaact gctacgctcc
1741 agcagcaacg cggccaccat ctccatcggc ggctctggcg agctgcagcg gcagcgggtc
1801 atggaagccg tgcatttccg tgtgcgccac accatcacga tccccaaccg tggaggcgca
1861 ggtgcggtga caggtcccga cgagtgggcg gactttggct ttgacctgcc tgactgcaag
1921 tcccgtaagc agcccatcaa agaggagttc acagagacag agagccactg aggaacgtac
1981 cttcttctcc tgtccttcct ctgtgagaaa ctgctcttgg aagtgggacc tgttggctgt
2041 gcccacagaa accagcaagg accttctgcc ggatgccatt cctgaaggga agtcgctcat
2101 gaactaactc cctcttggaa acttctggaa ctgcccttag ctacatatac acaagggcag
2161 gtggtgagcc aagtgctgag acagggagct gtccctttgt gggtgggtat gcagcaccca
2221 tttgcttctc ccgttctcta ttgaggactc tgccacctcc aggacagagc agcatccttc
2281 acttgctcac cctctgccac aaagtattcc aacatcttct gttcctgcta accatgcaca
2341 gcccagcctc tgtgtcatca gcgcttacgt acaggtcgat tccactgtgt cttgaaagtg
2401 aattcagggc cagagacatc ttctgcagga tgtgtggaca gatctgtccc taatgtaggt
2461 cattctgccg ttaccccttg tctcccgagt cttgattgct ggggtcaggg aagactgtgg
2521 cagagcaggg gaagccgctg gccctccgcc tctagccagc accctgaaca tgctggctgt
2581 agcagcctct agggacctct ctggtcagac aaagggacag aatgagtctc agactaccga
2641 aaattgaatt gtcaatattt gataaaaggt tactctttct acttggtggg gtcagcttgc
2701 tttttccccc ctctctgact ctctcagcat tcctttctga gatcagccta gtgtgtccac
2761 acgtacttct caacaagtct aaaacgccga gcatcaatcc aggaagggtc cttacctgtt
2821 accaggatgg ttggaaggga aagagactca gagagagcat agccgtggga gtgcaggtca
```

TABLE 1-continued

```
2881 gacagacccc agctgtgagg aacatctgtt ctcactaagt gctcagagtc tgggctctgt
2941 gcctgagtgc tagcccatcc tcgtggcctg gaactggagt ggctgctggg ggccctggtc
3001 ttcatgattc atccccaaag agtcagtggc tagagaaaca gctcctgcat gcattcagcc
3061 aatgggggcccc tgtacctgcc agaagctttg tgaacttctg caatgagagc cccccagcagt
3121 ccctgccagg agtggagaag cacagaggag cccctgccaa cagtaaagcc caacatctgc
3181 cgagtcactt tggagccatc ctctttaggc ttggctttca ttagcaaggc ccaacagagg
3241 cagtgacgtc cgtgggatag cctcagagtc agcactacca gggctggcgt catatcaggg
3301 ctgcctcctc gaagcccagg gacaatgttg ccaatcttag caatcttagc aagctctgca
3361 aacttaggtg gttaccaccc atgctatgct tcatgaatct ctgaggggca ggatttgggt
3421 gcacttaggg taggtgcagg catcacattg tcagagacca gtgctgacca tacaggcctt
3481 tccaacttga cagatgttga cagcttaggc tctggggggg tgggggttc ctgcacccag
3541 atgggccgtt aacagctgca gcatcaggct tgcttcttgg gtgtaggttg tggccctccc
3601 agtgagtggt aacacacttc acaaagcctg aggttgacta cacacttctt gttgctgctc
3661 agatgaggaa gctgaggcta gacagactga gtgccctgcc tcgggcatca gctcattgca
3721 gaagtgggtg ttcactcctg aggtacatgc tgccccatgc tacctcagaa actaggcagc
3781 acattctcac tcctaggcct gtgaacccca ctgagatgcg cttgcgttct gggatctcac
3841 ataagtatgt ctcaggcatt gtccaggagg gaccatccta agcgccccac cacatgctcc
3901 tgggaaggag gagtggttag gaggagtggt tgtcaccagg catctgagga gggaagagcc
3961 cccctccagc aaggacccag ggcttgtgtc tccctagacc ctgcctcaag tgccaaagct
4021 gtctcgtgag cttccaggat cctgacaggc ctggagggaa ctgcaaaggg ccatctgcca
4081 ggaaataaac gtcacagagg caatgcttgc agtgcctgag aagctctcca ggaaccagcc
4141 tttgggtctg aaccaaactt tgttctacaa aacacagaaa gcaagagaaa gcaaatcttc
4201 cagccaccaa ctttcccagg agcactggag tactagtttg gaaacaagtt tgggggtgcc
4261 ctggaagaca tctgttgagc aagggcaggt tgagcagggc tgtaaaagca ggccactcca
4321 gcctcagtct gtatggtccc atccagcttt gtgcatccaa ttaacagcag ctcccatgtc
4381 ccttcctggc cttgcttacc gtgcctgaca gctctacctt gggctgcttt gagcttgtga
4441 gttcgcagaa ccagcacccc tacgcaagaa tcctgcaagg gtcaaaagtt gccacttagt
4501 tgcatttcag atgggagaca aaaaccaaaa ctaaattgtc catgtttcaa tgtgatgaaa
4561 tgcttctcca agcagtattg atggatacag tctagtgact ctattaactg ttttgggtga
4621 tgtcatttta gaaaaatgtg ttattttttt tagctgtgtt tcggtgggaa tttttgtttt
4681 tgtaatataa taaaaatcac atgttcccat
```

SEQ ID NO: 129 Mouse TP73 isoform 1 amino acid sequence (NP_035772.3)

```
  1 maqtssssss tfehlwssle pdstyfdlpq psqgtseasg seesnmdvfh lqgmaqfnll
 61 ssamdqmgsr aapaspytpe haasapthsp yaqpsstfdt mspapvipsn tdypgphhfe
121 vtfqqsstak satwtyspll kklycqiakt cpiqikvstp pppgtairam pvykkaehvt
181 divkrcpnhe lgrdfnegqs apashlirve gnnlaqyvdd pvtgrqsvvv pyeppqvgte
241 fttilynfmc nsscvggmnr rpilviitle trdgqvlgrr sfegricacp grdrkadedh
301 yreqqalnes ttkngaaskr afkgsppaip algtnvkkrr hgdedmfymh vrgrenfeil
361 mkvkeslelm elvpqplvds yrqqqqqll qrpshlqpps ygpvlspmnk vhggvnklps
421 vnqlvgqppp hssaagpnlg pmgsgmlnsh ghsmpangem nghssqtmv sgshctpppp
481 yhadpslvsf ltglgcpnci ecftsqglqs iyhlqnltie dlgalkvpdq yrmtiwrglq
541 dlkqshdcgq qllrsssnaa tisiggsgel qrqrvmeavh frvrhtitip nrggagavtg
601 pdewadfgfd lpdcksrkqp ikeeftetes h
```

SEQ ID NO: 130 Mouse TP73 transcript variant 2 cDNA sequence (NM_001126330.1; CDS: 242-2014)

```
   1 gttgttggat gcagccagtt gacagaaatg agggagatgg gcagggtgag aatgccaact
  61 ctcagtccgc acgcctctga gcatcctccg ctcctgcctt cctagccaca gagcctcaac
 121 ccctcagtcc accccaccgg gcagccacca gtctacccct accccaccta gccacccaga
 181 cccatgcctc gtcccgcggc acaccagctc ctcagcgtgt gcagaccccc acgagcctac
 241 catgctttac gtcggtgacc ccatgagaca cctcgccacg gcccagttca atttgctcag
 301 cagtgccatg gaccagatgg gcagccgtgc ggccccggcg agcccctaca ccccggagca
 361 cgccgccagc gcgcccaccc actcgcccta cgcgcagccc agctccacct tcgacaccat
 421 gtctccggcg cctgtcatcc cttccaatac cgactacccc ggcccccacc acttcgaggt
 481 caccttccag cagtcgagca ctgccaagtc ggccacctgg acatactccc cactcttgaa
 541 gaagttgtac tgtcagattg ctaagacatg ccccatccag atcaaagtgt ccacaccacc
 601 acccccgggc acggccatcc gggccatgcc tgtctacaag aaggcagagc atgtgaccga
 661 cattgttaag gcgctgcccca accacgagct tggaagggac ttcaatgaag gacagtctgc
 721 cccggctagc cacctcatcc gtgtagaagg caacaacctc gcccagtacg tggatgaccc
 781 tgtcaccgga aggcagagtg tggttgtgcc gtatgaaccc ccacaggtgg gaacagaatt
 841 taccaccatc ctgtacaact tcatgtgtaa cagcagctgt gtgggggggca tgaatcggag
 901 gcccatcctt gtcatcatca ccctggagac ccgggatgga caggtcctgg gccgccggtc
 961 tttcgagggt cgcatctgtg cctgtcctgg ccgtgaccgc aaagctgatg aagaccatta
1021 ccgggagcaa caggctctga atgaaagtac caccaaaaat ggagctgcca gcaaacgtgc
1081 attcaagcag agccccccctg ccatccctgc cctgggtacc aacgtgaaga agagacgcca
1141 cggggacgag gacatgttct acatgcacgt gcgaggccgg gagaactttg agatcttgat
1201 gaaagtcaag gagagcctag aactgatgga gcttgtgccc cagcctttgg ttgactccta
1261 tcgacagcag cagcagcagc agctcctaca gaggccgagt cacctgcagc ctccatccta
1321 tgggcccgtg ctctccccaa tgaacaaggt acacggtggt gtcaacaaac tgccctccgt
1381 caaccagctg gtgggccagc ctcccccgca cagctcagca gctgggccca acctggggcc
1441 catgggctcc gggatgctca acagccacgg ccacagcatg ccggccaatg gtgagatgaa
1501 tggaggccac agctcccaga ccatggtttc gggatcccac tgcaccccgc cacccccccta
1561 tcatgcagac cccagcctcg tcagtttttt gacagggttg gggtgtccaa actgcatcga
1621 gtgcttcact tcccaagggt tgcagagcat ctaccacctg cagaacctta ccatcgagga
1681 ccttggggct ctgaaggtcc ctgaccagta ccgtatgacc atctggaggg gcctacagga
1741 cctgaagcag agccatgact gcggccagca actgctacgc tccagcagca acgcggccac
1801 catctccatc ggcggctctg gcgagctgca gcggcagcgg gtcatggaag ccgtgcattt
1861 ccgtgtgcgc cacaccatca cgatccccaa ccgtggaggc gcaggtgcgg tgacaggtcc
1921 cgacgagtgg gcggactttg gctttgacct gcctgactgc aagtcccgta agcagcccat
```

TABLE 1-continued

```
1981 caaagaggag ttcacagaga cagagagcca ctgaggaacg taccttcttc tcctgtcctt
2041 cctctgtgag aaactgctct tggaagtggg acctgttggc tgtgcccaca gaaaccagca
2101 aggaccttct gccggatgcc attcctgaag ggaagtcgct catgaactaa ctccctcttg
2161 gaaacttctg gaactgccct tagctacata tacacaaggg caggtggtga gccaagtgct
2221 gagacaggga gctgtccctt tgtgggtggg tatgcagcac ccatttgctt ctcccgttct
2281 ctattgagga ctctgccacc tccaggacag agcagcatcc ttcacttgct caccctctgc
2341 cacaaagtat tccaacatct tctgttcctg ctaaccatgc acagcccagc ctctgtgtca
2401 tcagcgctta cgtacaggtc gattccactg tgtcttgaaa gtgaattcag ggccagagac
2461 atcttctgca ggatgtgtgg acagatctgt ccctaatgta ggtcattctg ccgttacccc
2521 ttgtctcccg agtcttgatt gctggggtca gggaagactg tggcagagca ggggaagccg
2581 ctggccctcc gcctctagcc agcaccctga acatgctggc tgtagcagcc tctagggacc
2641 tctctggtca gacaaaggga cagaatgagt ctcagactac cgaaaattga attgtcaata
2701 tttgataaaa ggttactctt tctacttggt ggggtcagct tgctttttcc cccctctctg
2761 actctctcag cattcctttc tgagatcagc ctagtgtgtc cacacgtact tctcaacaag
2821 tctaaaacgc cgagcatcaa tccaggaagg gtccttacct gttaccagga tggttggaag
2881 ggaaagagac tcagagagag catagccgtg ggagtgcagg tcagacagac cccagctgtg
2941 aggaacatct gttctcacta agtgctcaga gtctgggctc tgtgcctgag tgctagccca
3001 tcctcgtggc ctggaactgg agtggctgct gggggccctg gtcttcatga ttcatcccca
3061 aagagtcagt ggctagagaa acagctcctg catgcattca gccaatgggg ccctgtacct
3121 gccagaagct ttgtgaactt ctgcaatgag agcccccagc agtccctgcc aggagtggag
3181 aagcacagag gagcccctgc caacagtaaa gcccaacatc tgccgagtca ctttggagcc
3241 atcctcttta ggcttggctt tcattagcaa ggcccaacag aggcagtgac gtccgtggga
3301 tagcctcaga gtcagcacta ccagggctgg cgtcatatca gggctgcctc ctcgaagccc
3361 agggacaatg ttgccaatct tagcaatctt agcaagctct gcaaacttag gtggttacca
3421 cccatgctat gcttcatgaa tctctgaggg gcaggatttg ggtgcactta gggtaggtgc
3481 aggcatcaca ttgtcagaga ccagtgctga ccatacaggc ctttccaact tgacagatgt
3541 tgacagctta ggctctgggg gggtgggggg ttcctgcacc cagatgggcc gttaacagct
3601 gcagcatcag gcttgcttct tgggtgtagg ttgtggccct cccagtgagt ggtaacacac
3661 ttcacaaagc ctgaggttga ctacacactt cttgttgctg ctcagatgag gaagctgagg
3721 ctagacagac tgagtgccct gcctcgggca tcagctcatt gcagaagtgg gtgttcactc
3781 ctgaggtaca tgctgcccca tgctacctca gaaactaggc agcacattct cactcctagg
3841 cctgtgaacc ccactgagat gcgcttgcgt tctgggatct cacataagta tgtctcaggc
3901 attgtccagg agggaccatc ctaagcgccc caccacatgc tcctgggaag gaggagtggt
3961 taggaggagt ggttgtcacc aggcatctga ggagggaaga gcccccctcc agcaaggacc
4021 cagggcttgt gtctccctag accctgcctc aagtgccaaa gctgtctcgt gagcttccag
4081 gatcctgaca ggcctggagg gaactgcaaa gggccatctg ccaggaaata aacgtcacag
4141 aggcaatgct tgcagtgcct gagaagctct ccaggaacca gcctttgggt ctgaaccaaa
4201 ctttgttcta caaaacacag aaagcaagag aaagcaaatc ttccagccac caactttccc
4261 aggagcactg gagtactagt ttggaaacaa gtttggggggt gccctggaag acatctgttg
4321 agcaagggca ggttgagcag ggctgtaaaa gcaggccact ccagcctcag tctgtatggt
4381 cccatccagc tttgtgcatc caattaacag cagctcccat gtcccttcct ggccttgctt
4441 accgtgcctg acagctctac cttgggctgc tttgagcttg tgagttcgca gaaccagcac
4501 ccctacgcaa gaatcctgca agggtcaaaa gttgccactt agttgcattt cagatgggag
4561 acaaaaacca aaactaaatt gtccatgttt caatgtgatg aaatgcttct ccaagcagta
4621 ttgatggata cagtctagtg actctattaa ctgttttggg tgatgtcatt ttagaaaaat
4681 gtgttatttt ttttagctgt gtttcggtgg gaatttttgt ttttgtaata taataaaaat
4741 cacatgttcc catggt
```

SEQ ID NO: 131 Mouse TP73 isoform 2 amino acid sequence (NP_001119802.1)

```
  1 mlyvgdpmrh lataqfnlls samdqmgsra apaspytpeh aasapthspy aqpsstfdtm
 61 spapvipsnt dypgphhfev tfqqsstaks atwtyspllk klycqiaktc piqikvstpp
121 ppgtairamp vykkaehvtd ivkrcpnhel grdfnegqsa pashlirveg nnlaqyvddp
181 vtgrqsvvvp yeppqvgtef ttilynfmcn sscvggmnrr pilviitlet rdgqvlgrrs
241 fegricacpg rdrkadedhy reqqalnest tkngaaskra fkqsppaipa lgtnvkkrrh
301 gdedmfymhv rgrenfeilm kvkeslelme lvpqplvdsy rqqqqqqllq rpshlqppsy
361 gpvlspmnkv hggvnklpsv nqlvgqppph ssaagpnlgp mgsgmlnshg hsmpangemn
421 gghssqtmvs gshctppppy hadpslvsfl tglgcpncie cftsqglqsi yhlqnltied
481 lgalkvpdqy rmtiwrglqd lkqshdcgqq llrsssnaat isiggsgelq rqrvmeavhf
541 rvrhtitipn rggagavtgp dewadfgfdl pdcksrkqpi keeftetesh
```

SEQ ID NO: 132 Mouse TP73 transcript variant 3 cDNA sequence (NM_001126331.1; CDS: 242-1726)

```
   1 gttgttggat gcagccagtt gacagaaatg agggagatgg gcagggtgag aatgccaact
  61 ctcagtccgc acgcctctga gcatcctccg ctcctgcctt cctagccaca gagcctcaac
 121 ccctcagtcc accccaccgg gcagccacca gtctacccct accccaccta gccacccaga
 181 cccatgcctc gtcccgcggc acaccagctc ctcagcgtgt gcagaccccc acgagcctac
 241 catgctttac gtcggtgacc ccatgagaca cctcgccacg gcccagttca atttgctcag
 301 cagtgccatg gaccagatgg gcagccgtgc ggcccccggcg agcccctaca ccccggagca
 361 cgccgccagc gcgcccaccc actcgcccta cgcgcagccc agctccacct tcgacaccat
 421 gtctccggcg cctgtcatcc cttccaatac cgactacccc ggcccccacc acttcgaggt
 481 caccttccag cagtcgagca ctgccaagtc ggccacctgg acatactccc cactcttgaa
 541 gaagttgtac tgtcagattg ctaagacatg ccccatccag atcaaagtgt ccacaccacc
 601 acccccgggc acggccatcc gggccatgcc tgtctacaag aaggcagagc atgtgaccga
 661 cattgttaag cgctgcccca accacgagct tggaagggac ttcaatgaag gacagtctgc
 721 cccggctagc cacctcatcc gtgtagaagg caacaacctc gcccagtacg tggatgaccc
 781 tgtcaccgga aggcagagtg tggttgtgcc gtatgaaccc ccacaggtgg gaacagaatt
 841 taccaccatc ctgtacaact tcatgtgtaa cagcagctgt gtggggggca tgaatcggag
 901 gcccatcctt gtcatcatca ccctggagac ccgggatgga caggtcctgg gccgccggtc
 961 tttcgagggt cgcatctgtg cctgtcctgg ccgtgaccgc aaagctgatg aagaccatta
1021 ccgggagcaa caggctctga atgaaagtac caccaaaaat ggagctgcca gcaaacgtgc
```

TABLE 1-continued 1081 attcaagcag agcccccctg ccatccctgc cctgggtacc aacgtgaaga agagacgcca
1141 cggggacgag gacatgttct acatgcacgt gcgaggccgg gagaactttg agatcttgat
1201 gaaagtcaag gagagcctag aactgatgga gcttgtgccc cagcctttgg ttgactccta
1261 tcgacagcag cagcagcagc agctcctaca gaggcctttt ttgacagggt tggggtgtcc
1321 aaactgcatc gagtgcttca cttcccaagg gttgcagagc atctaccacc tgcagaacct
1381 taccatcgag gaccttgggg ctctgaaggt ccctgaccag taccgtatga ccatctggag
1441 gggcctacag gacctgaagc agagccatga ctgcggccag caactgctac gctccagcag
1501 caacgcggcc accatctcca tcggcggctc tggcgagctg cagcggcagc gggtcatgga
1561 agccgtgcat ttccgtgtgc gccacaccat cacgatcccc aaccgtggag gcgcaggtgc
1621 ggtgacaggt cccgacgagt gggcggactt tggctttgac ctgcctgact gcaagtcccg
1681 taagcagccc atcaaagagg agttcacaga gacagagagc cactgaggaa cgtaccttct
1741 tctcctgtcc ttcctctgtg agaaactgct cttggaagtg ggacctgttg gctgtgccca
1801 cagaaaccag caaggacctt ctgccggatg ccattcctga agggaagtcg ctcatgaact
1861 aactccctct tggaaacttc tggaactgcc cttagctaca tatacacaag ggcaggtggt
1921 gagccaagtg ctgagacagg gagctgtccc tttgtgggtg ggtatgcagc acccatttgc
1981 ttctcccgtt ctctattgag gactctgcca cctccaggac agagcagcat ccttcacttg
2041 ctcaccctct gccacaaagt attccaacat cttctgttcc tgctaaccat gcacagccca
2101 gcctctgtgt catcagcgct tacgtacagg tcgattccac tgtgtcttga aagtgaattc
2161 agggccagag acatcttctg caggatgtgt ggacagatct gtccctaatg taggtcattc
2221 tgccgttacc ccttgtctcc cgagtcttga ttgctggggt cagggaagac tgtggcagag
2281 caggggaagc cgctggccct ccgcctctag ccagcaccct gaacatgctg gctgtagcag
2341 cctctaggga cctctctggt cagacaaagg gacagaatga gtctcagact accgaaaatt
2401 gaattgtcaa tatttgataa aaggttactc tttctacttg gtggggtcag cttgcttttt
2461 ccccccctctc tgactctctc agcattcctt tctgagatca gcctagtgtg tccacacgta
2521 cttctcaaca agtctaaaac gccgagcatc aatccaggaa gggtccttac ctgttaccag
2581 gatggttgga agggaaagag actcagagag agcatagccg tgggagtgca ggtcagacag
2641 accccagctg tgaggaacat ctgttctcac taagtgctca gagtctgggc tctgtgcctg
2701 agtgctagcc catcctcgtg gcctggaact ggagtggctg ctggggggccc tggtcttcat
2761 gattcatccc caaagagtca gtggctagag aaacagctcc tgcatgcatt cagccaatgg
2821 ggccctgtac ctgccagaag ctttgtgaac ttctgcaatg agagccccca gcagtccctg
2881 ccaggagtgg agaagcacag aggagcccct gccaacagta aagcccaaca tctgccgagt
2941 cactttggag ccatcctctt taggcttggc tttcattagc aaggcccaac agaggcagtg
3001 acgtccgtgg gatagcctca gagtcagcac taccagggct ggcgtcatat cagggctgcc
3061 tcctcgaagc ccagggacaa tgttgccaat cttagcaatc ttagcaagct ctgcaaactt
3121 aggtggttac cacccatgct atgcttcatg aatctctgag gggcaggatt tgggtgcact
3181 tagggtaggt gcaggcatca cattgtcaga gaccagtgct gaccatacag gcctttccaa
3241 cttgacagat gttgacagct taggctctgg gggggtgggg ggttcctgca cccagatggg
3301 ccgttaacag ctgcagcatc aggcttgctt cttgggtgta ggttgtggcc ctcccagtga
3361 gtggtaacac acttcacaaa gcctgaggtt gactacacac ttcttgttgc tgctcagatg
3421 aggaagctga ggctagacag actgagtgcc ctgcctcggg catcagctca ttgcagaagt
3481 gggtgttcac tcctgaggta catgctgccc catgctacct cagaaactag gcagcacatt
3541 ctcactccta ggcctgtgaa ccccactgag atgcgcttgc gttctgggat ctcacataag
3601 tatgtctcag gcattgtcca ggagggacca tcctaagcgc cccaccacat gctcctggga
3661 aggaggagtg gttaggagga gtggttgtca ccaggcatct gaggagggaa gagcccccct
3721 ccagcaagga cccagggctt gtgtctccct agaccctgcc tcaagtgcca aagctgtctc
3781 gtgagcttcc aggatcctga caggcctgga gggaactgca aagggccatc tgccaggaaa
3841 taaacgtcac agaggcaatg cttgcagtgc ctgagaagct ctccaggaac cagcctttgg
3901 gtctgaacca aactttgttc tacaaaacac agaaagcaag agaaagcaaa tcttccagcc
3961 accaactttc ccaggagcac tggagtacta gtttggaaac aagtttgggg gtgccctgga
4021 agacatctgt tgagcaaggg caggttgagc agggctgtaa aagcaggcca ctccagcctc
4081 agtctgtatg gtcccatcca gctttgtgca tccaattaac agcagctccc atgtcccttc
4141 ctggccttgc ttaccgtgcc tgacagctct accttgggct gctttgagct tgtgagttcg
4201 cagaaccagc acccctacgc aagaatcctg caagggtcaa aagttgccac ttagttgcat
4261 ttcagatggg agacaaaaac caaaactaaa ttgtccatgt ttcaatgtga tgaaatgctt
4321 ctccaagcag tattgatgga tacagtctag tgactctatt aactgttttg ggtgatgtca
4381 ttttagaaaa atgtgttatt ttttttagct gtgtttcggt gggaattttt gtttttgtaa
4441 tataataaaa atcacatgtt cccatggt SEQ ID NO: 133 Mouse TP73 isoform 3 amino acid sequence (NP_001119803.1)
1 mlyvgdpmrh lataqfnlls samdqmgsra apaspytpeh aasapthspy aqpsstfdtm
61 spapvipsnt dypgphhfev tfqqsstaks atwtyspllk klycqiaktc piqikvstpp
121 ppgtairamp vykkaehvtd ivkrcpnhel grdfnegqsa pashlirveg nnlaqyvddp
181 vtgrqsvvvp yeppqvgtef ttilynfmcn sscvggmnrr pilviitlet rdgqvlgrrs
241 fegricacpg rdrkadedhy reqqalnest tkngaaskra fkqsppaipa lgtnvkkrrh
301 gdedmfymhv rgrenfeilm kvkeslelme lvpqplvdsy rqqqqqllq rpfltglgcp
361 nciecftsqg lqsiyhlqnl tiedlgalkv pdqyrmtiwr glqdlkqshd cgqqllrsss
421 naatisiggs gelqrqrvme avhfrvrhti tipnrggaga vtgpdewadf gfdlpdcksr
481 kqpikeefte tesh SEQ ID NO: 134 Human SMAD1 transcript variant 1 cDNA sequence
(NM_001003688.1; CDS: 241-1638)
1 cactgcatgt gtattcgtga gttcgcggtt gaacaactgt tcctttactc tgctccctgt
61 ctttgtgctg actgggttac ttttttaaac actaggaatg gtaatttcta ctcttctgga
121 cttcaaacta agaagttaaa gagacttctc tgtaaataaa caaatctctt ctgctgtcct
181 tttgcatttg gagacagctt tatttcacca tatccaagga gtataactag tgctgtcatt
241 atgaatgtga caagtttatt ttcctttaca agtccagctg tgaagagact tcttgggtgg
301 aaacagggcg atgaagaaga aaaatgggca gagaaagctg ttgatgcttt ggtgaaaaaa
361 ctgaagaaaa agaaaggtgc catggaggaa ctggaaaagg ccttgagctg cccagggcaa
421 ccgagtaact gtgtcaccat tccccgctct ctggatggca ggctgcaagt ctcccaccgg
481 aaggactgc ctcatgtcat ttactgccgt gtgtggcgct ggcccgatct tcagagccac TABLE 1-continued

```
 541 catgaactaa aaccactgga atgctgtgag tttccttttg gttccaagca gaaggaggtc
 601 tgcatcaatc cctaccacta taagagagta gaaagccctg tacttcctcc tgtgctggtt
 661 ccaagacaca gcgaatataa tcctcagcac agcctcttag ctcagttccg taacttagga
 721 caaaatgagc ctcacatgcc actcaacgcc acttttccag attctttcca gcaacccaac
 781 agccacccgt ttcctcactc tcccaatagc agttacccaa actctcctgg gagcagcagc
 841 agcacctacc ctcactctcc caccagctca gacccaggaa gcccttttcca gatgccagct
 901 gatacgcccc cacctgctta cctgcctcct gaagacccca tgacccagga tggctctcag
 961 ccgatggaca caaacatgat ggcgcctccc ctgccctcag aaatcaacag aggagatgtt
1021 caggcggttg cttatgagga accaaaacac tggtgctcta ttgtctacta tgagctcaac
1081 aatcgtgtgg gtgaagcgtt ccatgcctcc tccacaagtg tgttggtgga tggtttcact
1141 gatccttcca acaataagaa ccgtttctgc cttgggctgc tctccaatgt taaccggaat
1201 tccactattg aaaacaccag gcggcatatt ggaaaaggag ttcatcttta ttatgttgga
1261 ggggaggtgt atgccgaatg ccttagtgac agtagcatct ttgtgcaaag tcggaactgc
1321 aactaccatc atggatttca tcctactact gtttgcaaga tccctagtgg gtgtagtctg
1381 aaaattttta acaaccaaga atttgctcag ttattggcac agtctgtgaa ccatggattt
1441 gagacagtct atgagcttac aaaaatgtgt actatacgta tgagctttgt gaagggctgg
1501 ggagcagaat accaccgcca ggatgttact agcacccccct gctggattga gatacatctg
1561 cacggccccc tccagtggct ggataaagtt cttactcaaa tgggttcacc tcataatcct
1621 atttcatctg tatcttaaat ggccccaggc atctgcctct ggaaaactat tgagccttgc
1681 atgtacttga aggatggatg agtcagacac gattgagaac tgacaaagga gccttgataa
1741 tacttgacct ctgtgaccaa ctgttggatt cagaaattta aacaaaaaaa aaaaaaaaca
1801 cacacacctt ggtaacatac tgttgatatc aagaacctgt ttagtttaca ttgtaacatt
1861 ctattgtaaa atcaactaaa attcagactt ttagcaggac tttgtgtaca gttaaaggag
1921 agatggccaa gccagggaca aattgtctat tagaaaacgg tcctaagaga ttctttggtg
1981 tttggcactt taaggtcatc gttgggcaga agtttagcat taatagttgt tctgaaacgt
2041 gttttatcag gtttagagcc catgttgagt cttcttttca tgggttttca taatatttta
2101 aaactatttg tttagcgatg gttttgttcg tttaagtaaa ggttaatctt gatgatatac
2161 ataataatct ttctaaaatt gtatgctgac catacttgct gtcagaataa tgctaggcat
2221 atgctttttg ctaaatatgt atgtacagag tatttggaag ttaagaattg attagactag
2281 tgaatttagg agtatttgag gtgggtgggg ggaagaggga aatgacaact gcaaatgtag
2341 actatactgt aaaaattcag tttgttgctt taaagaaaca aactgatacc tgaattttgc
2401 tgtgtttcca tttttagag attttttatca ttttttctc tctcggcatt ctttttctc
2461 atactcttca aaaagcagtt ctgcagctgg ttaattcatg taactgtgag agcaaatgaa
2521 taattcctgc tattctgaaa ttgcctacat gtttcaatac cagttatatg gagtgcttga
2581 atttaataag cagtttttac ggagtttaca gtacagaaat aggctttaat tttcaagtga
2641 attttttgcc aaacttagta actctgttaa atatttggag gatttaaaga acatcccagt
2701 ttgaattcat ttcaaacttt ttaaattttt ttgtactatg tttggtttta ttttccttct
2761 gttaatcttt tgtattcact tatgctctcg tacattgagt acttttattc caaaactagt
2821 gggttttctc tactggaaat tttcaataaa cctgtcatta ttgcttactt tgattaaaaa
```

SEQ ID NO: 135 Human SMAD1 transcript variant 2 cDNA sequence (NM_001354811.1; CDS: 664-2061)

```
   1 gctgtgggaa gcccagttcc cgggccccccg agcctcggct cccgggcctg accgcgctgg
  61 gatctccccg gccgcgctcc ccttccgcgc gctcctcaca tctctcccgt gctgccgccg
 121 ggccgaggcc cgttcgcgtg gcccgcggac ccattgtgtc ccccgcgccg gcggggcgac
 181 ccctgcggga gctggaggac gaccgctggc gctgctctcc aaggcgcctg gtggagcggg
 241 tctcgcgggc gggggacccc ggcgccccgg gcccctccac atcccgcacg ggttttcttc
 301 tcggccccag caagcctctt tggggtcgag gtcaaggaaa gttcgcaccg agatcccctc
 361 taatttattc aaaggtttgg cggcggcgcg taattttttc cccctcttcc gcctacaccc
 421 gctgcgtctc ctggtgtctc gttcctttcc ctttaccgga gtcgattgcc tcactgcatg
 481 tgtattcgtg ctgactgggt tacttttttta aacactagga atggtaattt ctactcttct
 541 ggacttcaaa ctaagaagtt aaagagactt ctctgtaaat aaacaaatct cttctgctgt
 601 ccttttgcat ttggagacag ctttatttca ccatatccaa ggagtataac tagtgctgtc
 661 attatgaatg tgacaagttt attttccttt acaagtccag ctgtgaagag acttcttggg
 721 tggaaacagg gcgatgaaga agaaaaatgg gcagagaaag ctgttgatgc tttggtgaaa
 781 aaactgaaga aaaagaaagg tgccatggag gaactggaaa aggccttgag ctgcccaggg
 841 caaccgagta actgtgtcac cattccccgc tctctggatg gcaggctgca agtctcccac
 901 cggaagggac tgcctcatgt catttactgc cgtgtgtggc gctggcccga tcttcagagc
 961 caccatgaac taaaaccact ggaatgctgt gagtttcctt ttggttccaa gcagaaggag
1021 gtctgcatca atccctacca ctataagaga gtagaaagcc ctgtacttcc tcctgtgctg
1081 gttccaagac acagcgaata taatcctcag cacagcctct tagctcagtt ccgtaactta
1141 ggacaaaatg agcctcacat gccactcaac gccacttttc cagattcttt ccagcaaccc
1201 aacagccacc cgtttcctca ctctcccaat agcagttacc caaactctcc tgggagcagc
1261 agcagcacct accctcactc tcccaccagc tcagacccag gaagcccttt ccagatgcca
1321 gctgatacgc ccccacctgc ttacctgcct cctgaagacc ccatgaccca ggatggctct
1381 cagccgatgg acacaaacat gatggcgcct cccctgccct cagaaatcaa cagaggagat
1441 gttcaggcgg ttgcttatga ggaaccaaaa cactggtgct ctattgtcta ctatgagctc
1501 aacaatcgtg tgggtgaagc gttccatgcc tcctccacaa gtgtgttggt ggatggtttc
1561 actgatcctt ccaacaataa gaaccgtttc tgccttgggc tgctctccaa tgttaaccgg
1621 aattccacta ttgaaaacac caggcggcat attggaaaag gagttcatct ttattatgtt
1681 ggaggggagg tgtatgccga atgccttagt gacagtagca tctttgtgca aagtcggaac
1741 tgcaactacc atcatggatt tcatcctact actgtttgca agatccctag tgggtgtagt
1801 ctgaaaattt ttaacaacca agaatttgct cagttattgg cacagtctgt gaaccatgga
1861 tttgagacag tctatgagct tacaaaaatg tgtactatac gtatgagctt tgtgaagggc
1921 tggggagcag aataccaccg ccaggatgtt actagcaccc cctgctggat tgagatacat
1981 ctgcacggcc ccctccagtg gctggataaa gttcttactc aaatgggttc acctcataat
2041 cctatttcat ctgtatctta aatggcccca ggcatctgcc tctggaaaac tattgagcct
2101 tgcatgtact tgaaggatgg atgagtcaga cacgattgag aactgacaaa ggagccttga
2161 taatacttga cctctgtgac caactgttgg attcagaaat ttaaacaaaa aaaaaaaaaa
2221 acacacacac cttggtaaca tactgttgat atcaagaacc tgtttagttt acattgtaac
```

TABLE 1-continued

```
2281 attctattgt aaaatcaact aaaattcaga cttttagcag gactttgtgt acagttaaag
2341 gagagatggc caagccaggg acaaattgtc tattagaaaa cggtcctaag agattctttg
2401 gtgtttggca ctttaaggtc atcgttgggc agaagtttag cattaatagt tgttctgaaa
2461 cgtgttttat caggtttaga gcccatgttg agtcttcttt tcatgggttt tcataatatt
2521 ttaaaactat ttgtttagcg atggttttgt tcgtttaagt aaaggttaat cttgatgata
2581 tacataataa tctttctaaa attgtatgct gaccatactt gctgtcagaa taatgctagg
2641 catatgcttt ttgctaaata tgtatgtaca gagtatttgg aagttaagaa ttgattagac
2701 tagtgaattt aggagtattt gaggtgggtg gggggaagag ggaaatgaca actgcaaatg
2761 tagactatac tgtaaaaatt cagtttgttg ctttaaagaa acaaactgat acctgaattt
2821 tgctgtgttt ccatttttta gagattttta tcattttttt ctctctcggc attctttttt
2881 ctcatactct tcaaaaagca gttctgcagc tggttaattc atgtaactgt gagagcaaat
2941 gaataattcc tgctattctg aaattgccta catgtttcaa taccagttat atggagtgct
3001 tgaatttaat aagcagtttt tacggagttt acagtacaga aataggcttt aattttcaag
3061 tgaatttttt gccaaactta gtaactctgt taaatatttg gaggatttaa agaacatccc
3121 agtttgaatt catttcaaac tttttaaatt tttttgtact atgtttggtt ttattttcct
3181 tctgttaatc ttttgtattc acttatgctc tcgtacattg agtactttta ttccaaaact
3241 agtgggtttt ctctactgga aattttcaat aaacctgtca ttattgctta ctttgattaa
3301 aaa
```

SEQ ID NO: 136 Human SMAD1 transcript variant 3 cDNA sequence (NM_001354812.1; CDS: 272-1669)

```
   1 caattctggg tacgtacaac ttctggggcc tgcaaattat tggagagtga gtgaggggca
  61 acgaaagata gacataaaag ggcgcgtctc gaaaggtgct gactgggtta ctttttttaaa
 121 cactaggaat ggtaatttct actcttctgg acttcaaact aagaagttaa agagacttct
 181 ctgtaaataa acaaatctct tctgctgtcc ttttgcattt ggagacagct ttatttcacc
 241 atatccaagg agtataacta gtgctgtcat tatgaatgtg acaagtttat tttcctttac
 301 aagtccagct gtgaagagac ttcttgggtg gaaacagggc gatgaagaag aaaaatgggc
 361 agagaaagct gttgatgctt tggtgaaaaa actgaagaaa aagaaaggtg ccatggagga
 421 actggaaaag gccttgagct gcccagggca accgagtaac tgtgtcacca ttccccgctc
 481 tctggatggc aggctgcaag tctcccaccg gaagggactg cctcatgtca tttactgccg
 541 tgtgtggcgc tggcccgatc ttcagagcca ccatgaacta aaaccactgg aatgctgtga
 601 gtttcctttt ggttccaagc agaaggaggt ctgcatcaat ccctaccact ataagagagt
 661 agaaagccct gtacttcctc ctgtgctggt tccaagacac agcgaatata atcctcagca
 721 cagcctctta gctcagttcc gtaacttagg acaaaatgag cctcacatgc cactcaacgc
 781 cacttttcca gattctttcc agcaacccaa cagccacccg tttcctcact ctcccaatag
 841 cagttaccca aactctcctg ggagcagcag cagcacctac cctcactctc ccaccagctc
 901 agacccagga agccctttcc agatgccagc tgatacgccc ccacctgctt acctgcctcc
 961 tgaagacccc atgacccagg atggctctca gccgatggac acaaacatga tggcgcctcc
1021 cctgccctca gaaatcaaca gaggagatgt tcaggcggtt gcttatgagg aaccaaaaca
1081 ctggtgctct attgtctact atgagctcaa caatcgtgtg ggtgaagcgt tccatgcctc
1141 ctccacaagt gtgttggtgg atggtttcac tgatccttcc aacaataaga accgtttctg
1201 ccttgggctg ctctccaatg ttaaccggaa ttccactatt gaaaacacca ggcggcatat
1261 tggaaaagga gttcatcttt attatgttgg aggggaggtg tatgccgaat gccttagtga
1321 cagtagcatc tttgtgcaaa gtcggaactg caactaccat catggatttc atcctactac
1381 tgtttgcaag atccctagtg ggtgtagtct gaaaattttt aacaaccaag aatttgctca
1441 gttattggca cagtctgtga accatggatt tgagacagtc tatgagctta caaaaatgtg
1501 tactatacgt atgagctttg tgaagggctg gggagcagaa taccaccgcc aggatgttac
1561 tagcaccccc tgctggattg agatacatct gcacggcccc ctccagtggc tggataaagt
1621 tcttactcaa atgggttcac ctcataatcc tatttcatct gtatcttaaa tggccccagg
1681 catctgcctc tggaaaacta ttgagccttg catgtacttg aaggatggat gagtcagaca
1741 cgattgagaa ctgacaaagg agccttgata atacttgacc tctgtgacca actgttggat
1801 tcagaaattt aaacaaaaaa aaaaaaaaac acacacacct tggtaacata ctgttgatat
1861 caagaacctg tttagtttac attgtaacat tctattgtaa aatcaactaa aattcagact
1921 tttagcagga ctttgtgtac agttaaagga gagatggcca agccagggac aaattgtcta
1981 ttagaaaacg gtcctaagag attctttggt gtttggcact ttaaggtcat cgttgggcag
2041 aagtttagca ttaatagttg ttctgaaacg tgttttatca ggtttagagc ccatgttgag
2101 tcttcttttc atgggttttc ataatatttt aaaactattt gtttagcgat ggttttgttc
2161 gtttaagtaa aggttaatct tgatgatata cataataatc tttctaaaat tgtatgctga
2221 ccatacttgc tgtcagaata atgctaggca tatgcttttt gctaaatatg tatgtacaga
2281 gtatttggaa gttaagaatt gattagacta gtgaatttag gagtatttga ggtgggtggg
2341 gggaagaggg aaatgacaac tgcaaatgta gactatactg taaaaattca gtttgttgct
2401 ttaaagaaac aaactgatac ctgaattttg ctgtgtttcc attttttaga gatttttatc
2461 attttttttct ctctcggcat tcttttttct catactcttc aaaaagcagt tctgcagctg
2521 gttaattcat gtaactgtga gagcaaatga ataattcctg ctattctgaa attgcctaca
2581 tgtttcaata ccagttatat ggagtgcttg aatttaataa gcagttttta cggagtttac
2641 agtacagaaa taggctttaa ttttcaagtg aattttttgc caaacttagt aactctgtta
2701 aatatttgga ggatttaaag aacatcccag tttgaattca tttcaaactt tttaaatttt
2761 tttgtactat gtttggtttt attttccttc tgttaatctt ttgtattcac ttatgctctc
2821 gtacattgag tacttttatt ccaaaactag tgggttttct ctactggaaa ttttcaataa
2881 acctgtcatt attgcttact ttgattaaaa a
```

SEQ ID NO: 137 Human SMAD1 transcript variant 4 cDNA sequence (NM_001354813.1; CDS: 280-1677)

```
   1 gccgtcctcc ggccccggcc gcgctgcgct cacgccggcc gggccgggaa tttggagagg
  61 atccctggtc gcgcggcagc ggcggcggcg cgcgggtgag cgggtgctga ctgggttact
 121 tttttaaaca ctaggaatgg taatttctac tcttctggac ttcaaactaa gaagttaaag
 181 agacttctct gtaaataaac aaatctcttc tgctgtcctt ttgcatttgg agacagcttt
 241 atttcaccat atccaaggag tataactagt gctgtcatta tgaatgtgac aagtttattt
 301 tcctttacaa gtccagctgt gaagagactt cttgggtgga aacagggcga tgaagaagaa
 361 aaatgggcag agaaagctgt tgatgctttg gtgaaaaaac tgaagaaaaa gaaaggtgcc
```

TABLE 1-continued

```
 421 atggaggaac tggaaaaggc cttgagctgc ccagggcaac cgagtaactg tgtcaccatt
 481 ccccgctctc tggatggcag gctgcaagtc tcccaccgga agggactgcc tcatgtcatt
 541 tactgccgtg tgtggcgctg gcccgatctt cagagccacc atgaactaaa accactggaa
 601 tgctgtgagt ttccttttgg ttccaagcag aaggaggtct gcatcaatcc ctaccactat
 661 aagagagtag aaagccctgt acttcctcct gtgctggttc caagacacag cgaatataat
 721 cctcagcaca gcctcttagc tcagttccgt aacttaggac aaaatgagcc tcacatgcca
 781 ctcaacgcca cttttccaga ttctttccag caacccaaca gccacccgtt tcctcactct
 841 cccaatagca gttacccaaa ctctcctggg agcagcagca gcacctaccc tcactctccc
 901 accagctcag acccaggaag ccctttccag atgccagctg atacgccccc acctgcttac
 961 ctgcctcctg aagaccccat gacccaggat ggctctcagc cgatggacac aaacatgatg
1021 gcgcctcccc tgccctcaga aatcaacaga ggagatgttc aggcggttgc ttatgaggaa
1081 ccaaaacact ggtgctctat tgtctactat gagctcaaca atcgtgtggg tgaagcgttc
1141 catgcctcct ccacaagtgt gttggtggat ggtttcactg atccttccaa caataagaac
1201 cgtttctgcc ttgggctgct ctccaatgtt aaccggaatt ccactattga aaacaccagg
1261 cggcatattg gaaaaggagt tcatctttat tatgttggag gggaggtgta tgccgaatgc
1321 cttagtgaca gtagcatctt tgtgcaaagt cggaactgca actaccatca tggatttcat
1381 cctactactg tttgcaagat ccctagtggg tgtagtctga aaatttttaa caaccaagaa
1441 tttgctcagt tattggcaca gtctgtgaac catggatttg agacagtcta tgagcttaca
1501 aaaatgtgta ctatacgtat gagctttgtg aagggctggg gagcagaata ccaccgccag
1561 gatgttacta gcaccccctg ctggattgag atacatctgc acggccccct ccagtggctg
1621 gataaagttc ttactcaaat gggttcacct cataatccta tttcatctgt atcttaaatg
1681 gccccaggca tctgcctctg gaaaactatt gagccttgca tgtacttgaa ggatggatga
1741 gtcagacacg attgagaact gacaaaggag ccttgataat acttgacctc tgtgaccaac
1801 tgttggattc agaaatttaa acaaaaaaaa aaaaaaacac acacaccttg gtaacatact
1861 gttgatatca agaacctgtt tagtttacat tgtaacattc tattgtaaaa tcaactaaaa
1921 ttcagacttt tagcaggact ttgtgtacag ttaaaggaga gatggccaag ccagggacaa
1981 attgtctatt agaaaacggt cctaagagat tctttggtgt ttggcacttt aaggtcatcg
2041 ttgggcagaa gtttagcatt aatagttgtt ctgaaacgtg ttttatcagg tttagagccc
2101 atgttgagtc ttcttttcat gggttttcat aatattttaa aactatttgt ttagcgatgg
2161 ttttgttcgt ttaagtaaag gttaatcttg atgatataca taataatctt tctaaaattg
2221 tatgctgacc atacttgctg tcagaataat gctaggcata tgctttttgc taaatatgta
2281 tgtacagagt atttggaagt taagaattga ttagactagt gaatttagga gtatttgagg
2341 tgggtggggg gaagagggaa atgacaactg caaatgtaga ctatactgta aaaattcagt
2401 ttgttgcttt aaagaaacaa actgatacct gaattttgct gtgtttccat tttttagaga
2461 tttttatcat ttttttctct ctcggcattc ttttttctca tactcttcaa aaagcagttc
2521 tgcagctggt taattcatgt aactgtgaga gcaaatgaat aattcctgct attctgaaat
2581 tgcctacatg tttcaatacc agttatatgg agtgcttgaa tttaataagc agtttttacg
2641 gagtttacag tacagaaata ggctttaatt ttcaagtgaa ttttttgcca aacttagtaa
2701 ctctgttaaa tatttggagg atttaaagaa catcccagtt tgaattcatt tcaaactttt
2761 taaatttttt tgtactatgt ttggttttat tttccttctg ttaatctttt gtattcactt
2821 atgctctcgt acattgagta cttttattcc aaaactagtg ggttttctct actggaaatt
2881 ttcaataaac ctgtcattat tgcttacttt gattaaaaa
```

SEQ ID NO: 138 Human SMAD1 transcript variant 5 cDNA sequence
(NM_001354814.1; CDS: 272-1669)

```
   1 gccgtcctcc ggccccggcc gcgctgcgct cacgccggcc gggccgggaa tttggagagg
  61 atccctggtc gcgcggcagc ggcggcggcg cgcgggtgct gactgggtta ctttttttaaa
 121 cactaggaat ggtaatttct actcttctgg acttcaaact aagaagttaa agagacttct
 181 ctgtaaataa acaaatctct tctgctgtcc ttttgcattt ggagacagct ttatttcacc
 241 atatccaagg agtataacta gtgctgtcat tatgaatgtg acaagtttat tttcctttac
 301 aagtccagct gtgaagagac ttcttgggtg gaaacagggc gatgaagaag aaaaatgggc
 361 agagaaagct gttgatgctt tggtgaaaaa actgaagaaa aagaaaggtg ccatggagga
 421 actggaaaag gccttgagct gcccagggca accgagtaac tgtgtcacca ttccccgctc
 481 tctggatggc aggctgcaag tctcccaccg gaagggactg cctcatgtca tttactgccg
 541 tgtgtggcgc tggcccgatc ttcagagcca ccatgaacta aaaccactgg aatgctgtga
 601 gtttcctttt ggttccaagc agaaggaggt ctgcatcaat ccctaccact ataagagagt
 661 agaaagccct gtacttcctc ctgtgctggt tccaagacac agcgaatata atcctcagca
 721 cagcctctta gctcagttcc gtaacttagg acaaaatgag cctcacatgc cactcaacgc
 781 cacttttcca gattctttcc agcaacccaa cagccacccg tttcctcact ctcccaatag
 841 cagttaccca aactctcctg ggagcagcag cagcacctac cctcactctc ccaccagctc
 901 agacccagga agccctttcc agatgccagc tgatacgccc ccacctgctt acctgcctcc
 961 tgaagacccc atgacccagg atggctctca gccgatggac acaaacatga tggcgcctcc
1021 cctgccctca gaaatcaaca gaggagatgt tcaggcggtt gcttatgagg aaccaaaaca
1081 ctggtgctct attgtctact atgagctcaa caatcgtgtg ggtgaagcgt tccatgcctc
1141 ctccacaagt gtgttggtgg atggtttcac tgatccttcc aacaataaga accgtttctg
1201 ccttgggctg ctctccaatg ttaaccggaa ttccactatt gaaaacacca ggcggcatat
1261 tggaaaagga gttcatcttt attatgttgg aggggaggtg tatgccgaat gccttagtga
1321 cagtagcatc tttgtgcaaa gtcggaactg caactaccat catggatttc atcctactac
1381 tgtttgcaag atccctagtg ggtgtagtct gaaaattttt aacaaccaag aatttgctca
1441 gttattggca cagtctgtga accatggatt tgagacagtc tatgagctta caaaaatgtg
1501 tactatacgt atgagctttg tgaagggctg gggagcagaa taccaccgcc aggatgttac
1561 tagcaccccc tgctggattg agatacatct gcacggcccc ctccagtggc tggataaagt
1621 tcttactcaa atgggttcac ctcataatcc tatttcatct gtatcttaaa tggccccagg
1681 catctgcctc tggaaaacta ttgagccttg catgtacttg aaggatggat gagtcagaca
1741 cgattgagaa ctgacaaagg agccttgata atacttgacc tctgtgacca actgttggat
1801 tcagaaattt aaacaaaaaa aaaaaaaaac acacacacct tggtaacata ctgttgatat
1861 caagaacctg tttagtttac attgtaacat tctattgtaa aatcaactaa aattcagact
1921 tttagcagga ctttgtgtac agttaaagga gagatggcca agccagggac aaattgtcta
1981 ttagaaaacg gtcctaagag attctttggt gtttggcact ttaaggtcat cgttgggcag
2041 aagtttagca ttaatagttg ttctgaaacg tgttttatca ggtttagagc ccatgttgag
```

TABLE 1-continued

```
2101 tcttcttttc atgggttttc ataatatttt aaaactattt gtttagcgat ggttttgttc
2161 gtttaagtaa aggttaatct tgatgatata cataataatc tttctaaaat tgtatgctga
2221 ccatacttgc tgtcagaata atgctaggca tatgcttttt gctaaatatg tatgtacaga
2281 gtatttggaa gttaagaatt gattagacta gtgaatttag gagtatttga ggtgggtggg
2341 gggaagaggg aaatgacaac tgcaaatgta gactatactg taaaaattca gtttgttgct
2401 ttaaagaaac aaactgatac ctgaattttg ctgtgtttcc atttttttaga gatttttatc
2461 atttttttct ctctcggcat tcttttttct catactcttc aaaaagcagt tctgcagctg
2521 gttaattcat gtaactgtga gagcaaatga ataattcctg ctattctgaa attgcctaca
2581 tgtttcaata ccagttatat ggagtgcttg aatttaataa gcagtttttta cggagtttac
2641 agtacagaaa taggctttaa ttttcaagtg aattttttgc caaacttagt aactctgtta
2701 aatatttgga ggatttaaag aacatcccag tttgaattca tttcaaactt tttaaatttt
2761 tttgtactat gtttggtttt attttccttc tgttaatctt ttgtattcac ttatgctctc
2821 gtacattgag tacttttatt ccaaaactag tgggttttct ctactggaaa ttttcaataa
2881 acctgtcatt attgcttact ttgattaaaa a
```

SEQ ID NO: 139 Human SMAD1 transcript variant 6 cDNA sequence
(NM_001354816.1; CDS: 551-1948)

```
   1 gctgtgggaa gcccagttcc cgggcccccg agcctcggct cccgggcctg accgcgctgg
  61 gatctccccg gccgcgctcc ccttccgcgc gctcctcaca tctctcccgt gctgccgccg
 121 ggccgaggcc cgttcgcgtg gcccgcggac ccattgtgtc ccccgcgccg gcggggcgac
 181 ccctgcggga gctggaggac gaccgctggc gctgctctcc aaggcgcctg gtggagcggg
 241 tctcgcgggc gggggacccc ggcgccccgg gcccctccac atcccgcacg ggttttcttc
 301 tcggccccag caagcctctt tggggtcgag gtcaaggaaa gttcgcaccg agatcccctc
 361 taatttattc aaaggtgctg actgggttac tttttttaaac actaggaatg gtaatttcta
 421 ctcttctgga cttcaaacta agaagttaaa gagacttctc tgtaaataaa caaatctctt
 481 ctgctgtcct tttgcatttg gagacagctt tatttcacca tatccaagga gtataactag
 541 tgctgtcatt atgaatgtga caagtttatt ttcctttaca agtccagctg tgaagagact
 601 tcttgggtgg aaacagggcg atgaagaaga aaaatgggca gagaaagctg ttgatgcttt
 661 ggtgaaaaaa ctgaagaaaa agaaaggtgc catggaggaa ctggaaaagg ccttgagctg
 721 cccagggcaa ccgagtaact gtgtcaccat tccccgctct ctggatggca ggctgcaagt
 781 ctcccaccgg aagggactgc ctcatgtcat ttactgccgt gtgtggcgct ggcccgatct
 841 tcagagccac catgaactaa aaccactgga atgctgtgag tttccttttg gttccaagca
 901 gaaggaggtc tgcatcaatc cctaccacta taagagagta gaaagccctg tacttcctcc
 961 tgtgctggtt ccaagacaca gcgaatataa tcctcagcac agcctcttag ctcagttccg
1021 taacttagga caaaatgagc ctcacatgcc actcaacgcc acttttccag attctttcca
1081 gcaacccaac agccacccgt ttcctcactc tcccaatagc agttacccaa actctcctgg
1141 gagcagcagc agcacctacc ctcactctcc caccagctca gacccaggaa gccctttcca
1201 gatgccagct gatacgcccc cacctgctta cctgcctcct gaagacccca tgacccagga
1261 tggctctcag ccgatggaca caaacatgat ggcgcctccc ctgccctcag aaatcaacag
1321 aggagatgtt caggcggttg cttatgagga accaaaacac tggtgctcta ttgtctacta
1381 tgagctcaac aatcgtgtgg gtgaagcgtt ccatgcctcc tccacaagtg tgttggtgga
1441 tggtttcact gatccttcca acaataagaa ccgtttctgc cttgggctgc tctccaatgt
1501 taaccggaat tccactattg aaaacaccag gcggcatatt ggaaaaggag ttcatcttta
1561 ttatgttgga ggggaggtgt atgccgaatg ccttagtgac agtagcatct ttgtgcaaag
1621 tcggaactgc aactaccatc atggatttca tcctactact gtttgcaaga tccctagtgg
1681 gtgtagtctg aaaattttta acaaccaaga atttgctcag ttattggcac agtctgtgaa
1741 ccatggattt gagacagtct atgagcttac aaaaatgtgt actatacgta tgagctttgt
1801 gaagggctgg ggagcagaat accaccgcca ggatgttact agcacccccct gctggattga
1861 gatacatctg cacggccccc tccagtggct ggataaagtt cttactcaaa tgggttcacc
1921 tcataatcct atttcatctg tatcttaaat ggccccaggc atctgcctct ggaaaactat
1981 tgagccttgc atgtacttga aggatggatg agtcagacac gattgagaac tgacaaagga
2041 gccttgataa tacttgacct ctgtgaccaa ctgttggatt cagaaattta aacaaaaaaa
2101 aaaaaaaaca cacacacctt ggtaacatac tgttgatatc aagaacctgt ttagtttaca
2161 ttgtaacatt ctattgtaaa atcaactaaa attcagactt ttagcaggac tttgtgtaca
2221 gttaaaggag agatggccaa gccagggaca aattgtctat tagaaaacgg tcctaagaga
2281 ttctttggtg tttggcactt taaggtcatc gttgggcaga agtttagcat taatagttgt
2341 tctgaaacgt gttttatcag gtttagagcc catgttgagt cttcttttca tgggttttca
2401 taatatttta aaactatttg tttagcgatg gttttgttcg tttaagtaaa ggttaatctt
2461 gatgatatac ataataatct ttctaaaatt gtatgctgac catacttgct gtcagaataa
2521 tgctaggcat atgcttttg ctaaatatgt atgtacagag tatttggaag ttaagaattg
2581 attagactag tgaatttagg agtatttgag gtgggtgggg ggaagaggga aatgacaact
2641 gcaaatgtag actatactgt aaaaattcag tttgttgctt taaagaaaca aactgatacc
2701 tgaattttgc tgtgtttcca ttttttagag atttttatca ttttttctc tctcggcatt
2761 cttttttctc atactcttca aaaagcagtt ctgcagctgg ttaattcatg taactgtgag
2821 agcaaatgaa taattcctgc tattctgaaa ttgcctacat gtttcaatac cagttatatg
2881 gagtgcttga atttaataag cagtttttac ggagtttaca gtacagaaat aggctttaat
2941 tttcaagtga atttttttgcc aaacttagta actctgttaa atatttggag gatttaaaga
3001 acatcccagt ttgaattcat ttcaaacttt ttaaattttt ttgtactatg tttggtttta
3061 ttttccttct gttaatcttt tgtattcact tatgctctcg tacattgagt acttttattc
3121 caaaactagt gggttttctc tactggaaat tttcaataaa cctgtcatta ttgcttactt
3181 tgattaaaaa
```

SEQ ID NO: 140 Human SMAD1 transcript variant 7 cDNA sequence
(NM_001354817.1; CDS: 549-1946)

```
   1 cactgcatgt gtattcgtga gttcgcggtt gaacaactgt tcctttactc tgctccctgt
  61 ctttgttagt gtttctcggg gttgtttctg taggaaggtg ggggtggtgg gcgtgagaga
 121 cagatgtggg cttgtttttc tagttgctga aactgtatga aggctttaaa gggagaacgt
 181 tttcttgatg tgctttagga ggggaggagg aacaaatgcc tgccagatct cacagctaca
 241 gtagctgagc ttttgtttat tttgaagagc atgcaatttt taaatacacg gtgcaagata
 301 accagtaaag gcgcgttcct tctgaaaatt gaggccggtc tcagaaccat ctcctgagaa
```

TABLE 1-continued

```
 361 agcatccttt tcgtgctgac tgggttactt ttttaaacac taggaatggt aatttctact
 421 cttctggact tcaaactaag aagttaaaga gacttctctg taaataaaca aatctcttct
 481 gctgtccttt tgcatttgga gacagcttta tttcaccata tccaaggagt ataactagtg
 541 ctgtcattat gaatgtgaca agtttatttt cctttacaag tccagctgtg aagagacttc
 601 ttgggtggaa acagggcgat gaagaagaaa aatgggcaga gaaagctgtt gatgctttgg
 661 tgaaaaaact gaagaaaaag aaaggtgcca tggaggaact ggaaaaggcc ttgagctgcc
 721 cagggcaacc gagtaactgt gtcaccattc cccgctctct ggatggcagg ctgcaagtct
 781 cccaccggaa gggactgcct catgtcattt actgccgtgt gtggcgctgg cccgatcttc
 841 agagccacca tgaactaaaa ccactggaat gctgtgagtt tcctttttggt tccaagcaga
 901 aggaggtctg catcaatccc taccactata agagagtaga aagccctgta cttcctcctg
 961 tgctggttcc aagacacagc gaatataatc ctcagcacag cctcttagct cagttccgta
1021 acttaggaca aaatgagcct cacatgccac tcaacgccac ttttccagat tctttccagc
1081 aacccaacag ccacccgttt cctcactctc ccaatagcag ttacccaaac tctcctggga
1141 gcagcagcag cacctaccct cactctccca ccagctcaga cccaggaagc cctttccaga
1201 tgccagctga tacgccccca cctgcttacc tgcctcctga agaccccatg acccaggatg
1261 gctctcagcc gatggacaca aacatgatgg cgcctcccct gccctcagaa atcaacagag
1321 gagatgttca ggcggttgct tatgaggaac caaaacactg gtgctctatt gtctactatg
1381 agctcaacaa tcgtgtgggt gaagcgttcc atgcctcctc cacaagtgtg ttggtggatg
1441 gtttcactga tccttccaac aataagaacc gtttctgcct tgggctgctc tccaatgtta
1501 accggaattc cactattgaa aacaccaggc ggcatattgg aaaaggagtt catctttatt
1561 atgttggagg ggaggtgtat gccgaatgcc ttagtgacag tagcatcttt gtgcaaagtc
1621 ggaactgcaa ctaccatcat ggatttcatc ctactactgt ttgcaagatc cctagtgggt
1681 gtagtctgaa aatttttaac aaccaagaat ttgctcagtt attggcacag tctgtgaacc
1741 atggatttga gacagtctat gagcttacaa aaatgtgtac tatacgtatg agctttgtga
1801 agggctgggg agcagaatac caccgccagg atgttactag caccccctgc tggattgaga
1861 tacatctgca cggcccctc cagtggctgg ataaagttct tactcaaatg ggttcacctc
1921 ataatcctat ttcatctgta tcttaaatgg ccccaggcat ctgcctctgg aaaactattg
1981 agccttgcat gtacttgaag gatggatgag tcagacacga ttgagaactg acaaaggagc
2041 cttgataata cttgacctct gtgaccaact gttggattca gaaatttaaa caaaaaaaaa
2101 aaaaaacaca cacaccttgg taacatactg ttgatatcaa gaacctgttt agtttacatt
2161 gtaacattct attgtaaaat caactaaaat tcagactttt agcaggactt tgtgtacagt
2221 taaaggagag atggccaagc cagggacaaa ttgtctatta gaaaacggtc ctaagagatt
2281 ctttggtgtt tggcacttta aggtcatcgt tgggcagaag tttagcatta atagttgttc
2341 tgaaacgtgt tttatcaggt ttagagccca tgttgagtct tcttttcatg ggttttcata
2401 atattttaaa actatttgtt tagcgatggt tttgttcgtt taagtaaagg ttaatcttga
2461 tgatatacat aataatcttt ctaaaattgt atgctgacca tacttgctgt cagaataatg
2521 ctaggcatat gctttttgct aaatatgtat gtacagagta tttggaagtt aagaattgat
2581 tagactagtg aatttaggag tatttgaggt gggtgggggg aagagggaaa tgacaactgc
2641 aaatgtagac tatactgtaa aaattcagtt tgttgcttta aagaaacaaa ctgatacctg
2701 aattttgctg tgtttccatt ttttagagat ttttatcatt tttttctctc tcggcattct
2761 tttttctcat actcttcaaa aagcagttct gcagctggtt aattcatgta actgtgagag
2821 caaatgaata attcctgcta ttctgaaatt gcctacatgt ttcaatacca gttatatgga
2881 gtgcttgaat ttaataagca gtttttacgg agtttacagt acagaaatag gctttaattt
2941 tcaagtgaat tttttgccaa acttagtaac tctgttaaat atttggagga tttaaagaac
3001 atcccagttt gaattcattt caaacttttt aaattttttt gtactatgtt tggttttatt
3061 ttccttctgt taatcttttg tattcactta tgctctcgta cattgagtac ttttattcca
3121 aaactagtgg gttttctcta ctggaaattt tcaataaacc tgtcattatt gcttactttg
3181 attaaaaa
```

SEQ ID NO: 141 Human SMAD1 transcript variant 8 cDNA sequence (NM_005900.3; CDS: 363-1760)

```
   1 agatcaatcc aggctccagg agaaagcagg cggcgggcg gagaaaggag aggccgagcg
  61 gctcaacccg ggccgaggct cggggagcgg agagtggcgc agcgcccggc cgtccggacc
 121 cgggccgcga gaccccgctc gcccggccac tcgtgctccc acacggacgg gcgcgccgcc
 181 aacccggtgc tgactgggtt acttttttaa acactaggaa tggtaatttc tactcttctg
 241 gacttcaaac taagaagtta aagagacttc tctgtaaata aacaaatctc ttctgctgtc
 301 cttttgcatt tggagacagc tttatttcac catatccaag gagtataact agtgctgtca
 361 ttatgaatgt gacaagttta ttttccttta caagtccagc tgtgaagaga cttcttgggt
 421 ggaaacaggg cgatgaagaa gaaaaatggg cagagaaagc tgttgatgct ttggtgaaaa
 481 aactgaagaa aaagaaaggt gccatggagg aactggaaaa ggccttgagc tgcccagggc
 541 aaccgagtaa ctgtgtcacc attccccgct ctctggatgg caggctgcaa gtctcccacc
 601 ggaagggact gcctcatgtc atttactgcc gtgtgtggcg ctggcccgat cttcagagcc
 661 accatgaact aaaaccactg gaatgctgtg agtttccttt tggttccaag cagaaggagg
 721 tctgcatcaa tccctaccac tataagagag tagaaagccc tgtacttcct cctgtgctgg
 781 ttccaagaca cagcgaatat aatcctcagc acagcctctt agctcagttc cgtaacttag
 841 gacaaaatga gcctcacatg ccactcaacg ccacttttcc agattctttc cagcaaccca
 901 acagccaccc gtttcctcac tctcccaata gcagttaccc aaactctcct gggagcagca
 961 gcagcaccta ccctcactct cccaccagct cagacccagg aagccctttc cagatgccag
1021 ctgatacgcc cccacctgct tacctgcctc ctgaagaccc catgacccag gatggctctc
1081 agccgatgga cacaaacatg atggcgcctc ccctgccctc agaaatcaac agaggagatg
1141 ttcaggcggt tgcttatgag gaaccaaaac actggtgctc tattgtctac tatgagctca
1201 acaatcgtgt gggtgaagcg ttccatgcct cctccacaag tgtgttggtg gatggtttca
1261 ctgatccttc caacaataag aaccgtttct gccttgggct gctctccaat gttaaccgga
1321 attccactat tgaaaacacc aggcggcata ttggaaaagg agttcatctt tattatgttg
1381 gaggggaggt gtatgccgaa tgccttagtg acagtagcat ctttgtgcaa agtcggaact
1441 gcaactacca tcatggattt catcctacta ctgtttgcaa gatccctagt gggtgtagtc
1501 tgaaaatttt taacaaccaa gaatttgctc agttattggc acagtctgtg aaccatggat
1561 ttgagacagt ctatgagctt acaaaaatgt gtactatacg tatgagcttt gtgaagggct
1621 ggggagcaga ataccaccgc caggatgtta ctagcacccc ctgctggatt gagatacatc
1681 tgcacggccc cctccagtgg ctggataaag ttcttactca aatgggttca cctcataatc
```

TABLE 1-continued

```
1741 ctatttcatc tgtatcttaa atggccccag gcatctgcct ctggaaaact attgagcctt
1801 gcatgtactt gaaggatgga tgagtcagac acgattgaga actgacaaag gagccttgat
1861 aatacttgac ctctgtgacc aactgttgga ttcagaaatt taaacaaaaa aaaaaaaaaa
1921 cacacacacc ttggtaacat actgttgata tcaagaacct gtttagttta cattgtaaca
1981 ttctattgta aaatcaacta aaattcagac ttttagcagg actttgtgta cagttaaagg
2041 agagatggcc aagccaggga caaattgtct attagaaaac ggtcctaaga gattctttgg
2101 tgtttggcac tttaaggtca tcgttgggca gaagtttagc attaatagtt gttctgaaac
2161 gtgttttatc aggtttagag cccatgttga gtcttctttt catgggtttt cataatattt
2221 taaaactatt tgtttagcga tggttttgtt cgtttaagta aaggttaatc ttgatgatat
2281 acataataat ctttctaaaa ttgtatgctg accatacttg ctgtcagaat aatgctaggc
2341 atatgctttt tgctaaatat gtatgtacag agtatttgga agttaagaat tgattagact
2401 agtgaattta ggagtatttg aggtgggtgg ggggaagagg gaaatgacaa ctgcaaatgt
2461 agactatact gtaaaaattc agtttgttgc tttaaagaaa caaactgata cctgaatttt
2521 gctgtgtttc catttttag agattttat catttttttc tctctcggca ttcttttttc
2581 tcatactctt caaaaagcag ttctgcagct ggttaattca tgtaactgtg agagcaaatg
2641 aataattcct gctattctga aattgcctac atgtttcaat accagttata tggagtgctt
2701 gaatttaata agcagttttt acggagttta cagtacagaa ataggcttta attttcaagt
2761 gaatttttg ccaaacttag taactctgtt aaatatttgg aggatttaaa gaacatccca
2821 gtttgaattc atttcaaact ttttaaattt ttttgtacta tgtttggttt tattttcctt
2881 ctgttaatct tttgtattca cttatgctct cgtacattga gtacttttat tccaaaacta
2941 gtgggttttc tctactggaa attttcaata aacctgtcat tattgcttac tttgattaaa
3001 aa
```

SEQ ID NO: 142 Human SMAD1 amino acid sequence
(NP_005891.1. NP_001341746.1, NP_001341745.1, NP_001341743.1, NP_001341742.1, NP_001341741.1, NP_001341740.1, NP_001003688.1)

```
  1 mnvtslfsft spavkrllgw kqgdeeekwa ekavdalvkk lkkkkgamee lekalscpgq
 61 psncvtiprs ldgrlqvshr kglphviycr vwrwpdlqsh helkplecce fpfgskqkev
121 cinpyhykrv espvlppvlv prhseynpqh sllaqfrnlg qnephmplna tfpdsfqqpn
181 shpfphspns sypnspgsss styphsptss dpgspfqmpa dtpppaylpp edpmtqdgsq
241 pmdtnmmapp lpseinrgdv qavayeepkh wcsivyyeln nrvgeafhas stsvlvdgft
301 dpsnnknrfc lgllsnvnrn stientrrhi gkgvhlyyvg gevyaeclsd ssifvqsrnc
361 nyhhgfhptt vckipsgcsl kifnnqefaq llaqsvnhgf etvyeltkmc tirmsfvkgw
421 gaeyhrqdvt stpcwieihl hgplqwldkv ltqmgsphnp issvs
```

SEQ ID NO: 143 Mouse SMAD1 cDNA sequence (NM_008539.4; CDS: 358-1755)

```
   1 agatcaatcc aggctcgggg agcgagcggg cgcaccaagg cgaggccggg gccgaggcgc
  61 ggggacggcg gcccggagct aagcagagcg cggggacggc ggccgggagc ggatcggagc
 121 acgggacccg gcgccgggtc tcgtgcgtcc ctgcggatgg gcgcgccgcc gagccggcgc
 181 taactgggat cctcgctgga acaggaggga cagtattttc tacctttcca aaccgcagac
 241 caagaagcta aggagaatct atgtaaatat actgaaatct ctgttggctc tgcgcccaac
 301 accccggagc tggcacctca ccctgtctga ggagcgtgta gaactagacc agccgctatg
 361 aatgtgacca gcttgttttc attcacaagt ccagctgtga agagactcct tgggtggaaa
 421 cagggcgatg aagaagagaa atgggcagag aaagctgtgg acgctttggt gaagaaactg
 481 aagaagaaga aaggggccat ggaagagctg gagaaggccc tgagctgccc tggacagccg
 541 agtaactgcg tcaccattcc tcgctccctg gatggcaggt tgcaggtgtc ccaccggaag
 601 ggactacctc atgtcattta ttgccgtgtg tggcgctggc ccgacctcca gagccaccat
 661 gaactgaagc ctctggaatg ctgtgagttc ccatttggtt ccaagcagaa ggaggtctgc
 721 atcaacccct accactataa gcgagtggag agcccggttc tcccgccggt gctggttccg
 781 aggcacagcg agtacaatcc tcagcacagc cttctggctc agttccgcaa cctgggacaa
 841 aatgagcctc acatgccact gaacgccacg ttcccagact ctttccagca gcccaacagc
 901 cacccgttcc cccactcccc caacagcagc taccccaact ctcctggcgg cagcagcagc
 961 acctaccctc actccccaac cagctcagac ccgggcagcc cttttcagat gccagctgac
1021 acacccccac ctgcttacct gcctcctgaa gaccccatgg cccaggatgg ctctcagccc
1081 atggacacga acatgatggc gcctccactg cccgctgaaa tcagcagagg agatgttcag
1141 gcagttgctt acgaggaacc aaaacactgg tgctctattg tgtactatga gctcaacaac
1201 cgtgtgggtg aagcgttcca cgcctcgtcc accagcgtgc tggtggatgg tttcacagat
1261 ccgtccaaca ataagaaccg cttctgcctt ggcttgctct ccaacgttaa ccggaattcc
1321 actattgaaa acaccaggcg acatattggg aaaggagtcc acctttatta cgttggagga
1381 gaggtgtatg cggaatgcct cagtgacagc agcatcttcg tgcagagccg gaactgcaac
1441 taccaccacg gctttcaccc caccaccgtc tgcaagatcc ccagcgggtg cagcttgaaa
1501 atcttcaaca accaagagtt tgctcagcta ctggcgcagt ctgtgaacca cgggttcgag
1561 accgtgtatg aactcaccaa aatgtgcact attcggatga gcttcgtgaa gggttgggga
1621 gccgaatacc accggcagga tgttaccagc accccctgct ggattgagat ccatctgcat
1681 ggccctctcc agtggctgga taaggttctg acccagatgg gctcacccca caatcctatt
1741 tcatccgtgt cttaaaagac ctgtggcttc cgtctcttgc aaactatcga gccttgcatg
1801 tacttgaagg atggacaagt cagacaggat ggagacctga cgaaggagcc acgataatac
1861 ttgacctctg tgaccaacta ttggattgag aaactgacaa gccttggttg atagcaagaa
1921 ccctttcagt ttacattgtg acattctgtt gtaaaaatca actaaaatgc tgactttcag
1981 caggactttt gtgtatagtt aaaaaaaaaa gagatggcca agccagggac aaattatcta
2041 ttaggaaaaa agaaaaaaat gattgtaatc aatccttttg tgtggggtgt tggcagaagg
2101 ttggcgctga tagtctttct gaagtgggct ttcatcaggc tcagagccca cgttgaatca
2161 tcttctcatg ggttttctta atattttaaa actacttgtt tagaaatgaa tgggtttttt
2221 gtttgttttt aaagtacagg ttaatcgtta tgacatgcat agtaatcttt ctgaaactgt
2281 atgctggctg tattactgtc agaatgatgg caggcatatg ctctttgcta aatatgtata
2341 tacagaatat ttggaggtta tgaatagtct aaatggctag tgggtttaca gagtatctga
2401 ggggcggggt cgggaagaaa acgacggctg caaatgtaga ctataccgta aagctcagct
2461 tgctgcctta aacagacaag ctggtgtctg aatttgctgt gtttcagttt ttgtagagtt
2521 ttatctgact tcttttcttc tgtcttatcc gctccacggc acagttaagc agctggttaa
2581 ttcctctaac tgtgagagca gatgagtaat tccttctgtt cgcaaatcaa ctggcttcgt
```

TABLE 1-continued

```
2641 gtttcagtac ccagtatatg aaaagcttga attgaatgag cagtttttat ggagtttaca
2701 gtacagacat aggctttgat ttccaaataa attgtttgcc aaacctggta actctgttca
2761 ttattcgcag gattaaagat ctctctattg gaatccattt caaaggttgt ttttttgtt
2821 tttgttttg tttttgttt tattttgatt tgtttttttt tgtactattt ggtttctttt
2881 cttctgttaa tttttttatt ctcctttgct cttatacagc gagtactttt attccaacac
2941 tagcagggtt tttctctact ggaaattttt aaataaaacc tgtcattatt gcttactttg
3001 attaaaaaaa aaaaaaaaaa aaaaaaaaaa aaaaaaaaaa
```

SEQ ID NO: 144 Mouse SMAD1 isoform amino acid sequence (NP_0325652)

```
  1 mnvtslfsft spavkrllgw kqgdeeekwa ekavdalvkk lkkkkgamee lekalscpgq
 61 psncvtiprs ldgrlqvshr kglphviycr vwrwpdlqsh helkplecce fpfgskqkev
121 cinpyhykrv espvlppvlv prhseynpqh sllaqfrnlg qnephmpina tfpdsfqqpn
181 shpfphspns sypnspggss styphsptss dpgspfqmpa dtpppaylpp edpmaqdgsq
241 pmdtnmmapp lpaeisrgdv qavayeepkh wcsivyyeln nrvgeafhas stsvlvdgft
301 dpsnnknrfc lgllsnvnrn stientrrhi gkgvhlyyvg gevyaeclsd ssifvqsrnc
361 nyhhgfhptt vckipsgcsl kifnnqefaq llaqsvnhgf etvyeltkmc tirmsfvkgw
421 gaeyhrqdvt stpcwieihl hgplqwldkv ltqmgsphnp issvs
```

SEQ ID NO: 145 SMAD3 transcript variant 1 cDNA sequence (NM_005902.4; CDS: 554-1831)

```
   1 gaaacacaga ctgggagcgg gcgggagcgg gagcgcggcg cacgccccgg gccggcccag
  61 ccagcgagcg agcgagcggc gagccgggag gaggagggtg gcggggcggt gaggccgcag
 121 aggcggaggg atctgcgcat caaagctagc gaggcgagcg aagtttggcc gggggttgga
 181 ctttccttcc cggaggcggc acccaaacag ctaccccgtg cggaaaccca aacttctgct
 241 gccacttgga gtctcgcggc cgccgcctcc gccccgcgtt cggggccttc ccgaccctgc
 301 actgctgccg tccgcccgcc cggccgctct tctcttcgcc gtgggagccg ctccgggcgc
 361 agggccgcgc gccgagcccc gcaggctgca gcgccgcggc ccggcccggc gccccggcaa
 421 cttcgccgag agttgaggcg aagtttgggc gaccgcggca ggccccggcc gagctcccct
 481 ctgcgccccc ggcgtcccgt cgagcccagc cccgccgggg gcgctcctcg ccgccccgcgc
 541 gccctcccca gccatgtcgt ccatcctgcc tttcactccc ccgatcgtga agcgcctgct
 601 gggctggaag aagggcgagc agaacgggca ggaggagaaa tggtgcgaga aggcggtcaa
 661 gagcctggtc aagaaactca agaagacggg gcagctggac gagctggaga aggccatcac
 721 cacgcagaac gtcaacacca agtgcatcac catccccagg tccctggatg gccggttgca
 781 ggtgtcccat cggaaggggc tccctcatgt catctactgc cgcctgtggc gatggccaga
 841 cctgcacagc caccacgagc tacgggccat ggagctgtgt gagttcgcct tcaatatgaa
 901 gaaggacgag gtctgcgtga atccctacca ctaccagaga gtagagacac cagttctacc
 961 tcctgtgttg gtgccacgcc acacagagat cccggccgag ttcccccac tggacgacta
1021 cagccattcc atccccgaaa acactaactt ccccgcaggc atcgagcccc agagcaatat
1081 tccagagacc ccacccccctg gctacctgag tgaagatgga gaaaccagtg accaccagat
1141 gaaccacagc atggacgcag gttctccaaa cctatccccg aatccgatgt ccccagcaca
1201 taataacttg gacctgcagc cagttaccta ctgcgagccg gccttctggt gctccatctc
1261 ctactacgag ctgaaccagc gcgtcgggga gacattccac gcctcgcagc catccatgac
1321 tgtggatggc ttcaccgacc cctccaattc ggagcgcttc tgcctagggc tgctctccaa
1381 tgtcaacagg aatgcagcag tggagctgac acggagacac atcggaagag gcgtgcggct
1441 ctactacatc ggaggggagg tcttcgcaga gtgcctcagt gacagcgcta tttttgtcca
1501 gtctcccaac tgtaaccagc gctatggctg gcacccggcc accgtctgca agatcccacc
1561 aggatgcaac ctgaagatct tcaacaacca ggagttcgct gccctcctgg cccagtcggt
1621 caaccagggc tttgaggctg tctaccagtt gacccgaatg tgcaccatcc gcatgagctt
1681 cgtcaaaggc tggggagcgg agtacaggag acagactgtg accagtaccc cctgctggat
1741 tgagctgcac ctgaatgggc ctttgcagtg gcttgacaag gtcctcaccc agatgggctc
1801 cccaagcatc cgctgttcca gtgtgtctta gagacatcaa gtatggtagg ggagggcagg
1861 cttggggaaa atggccatgc aggaggtgga gaaaattgga actctactca acccattgtt
1921 gtcaaggaag aagaaatctt tctccctcaa ctgaaggggt gcacccacct gttttctgaa
1981 acacacgagc aaacccagag gtggatgtta tgaacagctg tgtctgccaa acacatttac
2041 cctttggccc cactttgaag ggcaagaaat ggcgtctgct ctggtggctt aagtgagcag
2101 aacaggtagt attacaccac cggcccccctc cccccagact cttttttga gtgacagctt
2161 tctgggatgt cacagtccaa ccagaaacac ccctctgtct aggactgcag tgtggagttc
2221 accttggaag ggcgttctag gtaggaagag cccgcagggc catgcagacc tcatgcccag
2281 ctctctgacg cttgtgacag tgcctcttcc agtgaacatt cccagcccag ccccgccccg
2341 ccccgcccca ccactccagc agaccttgcc ccttgtgagc tggatagact tgggatgggg
2401 agggagggag ttttgtctgt ctccctcccc tctcagaaca tactgattgg gaggtgcgtg
2461 ttcagcagaa cctgcacaca ggacagcggg aaaaatcgat gagcgccacc tctttaaaaa
2521 ctcacttacg tttgtccttt ttcactttga aaagttggaa ggatctgctg aggcccagtg
2581 catatgcaat gtatagtgtc tattatcaca ttaatctcaa agagattcga atgacggtaa
2641 gtgttctcat gaagcaggag gcccttgtcg tgggatggca tttggtctca ggcagcacca
2701 cactgggtgc gtctccagtc atctgtaaga gcttgctcca gattctgatg catacggcta
2761 tattggttta tgtagtcagt tgcattcatt aaatcaactt tatcatatgc tcttttaaat
2821 gtttggttta tatattttct ttaaaaatcc tgggctggca cattgactgg gaaacctgag
2881 tgagacccag caactgcttc tctcccttct ctctcctgag gtgaagcttt tccaggtttt
2941 gttgaagaga tacctgccag cacttctgca agctgaaatt tacagaagca aattcaccag
3001 aagggaaaca tctcaggcca acataggcaa atgaaaaggg ctattaaaat atttttacac
3061 ctttgaaaat tgcaggcttg gtacaaagag gtctgtcatc ttccccctgg gatataagat
3121 gatctagctc ccggtagagg atcaccggtg acaactatag cagttgtatt gtgtaacaag
3181 tactgctccc agcagcaatt agggagaaaa ctagtctaaa ttatttcaac tggaaaaaag
3241 aaaaaagagt cctcttcttt tcccagcctt ttgcagaaca cagtagacag aactgccacc
3301 ttcaattggt actttattct ttgctgctgt ttttgtataa aatgacctat cccacgtttt
3361 tgcatgaatt tatagcagga aaaatcaagg gatttcctat ggaagtcctg ctttattcca
3421 ggtgaaggga aggaagtgta tatacttttg gcaagtcata cagctcaaat gtgatgagat
3481 ttctgatgtt agagggagat ggagaggctt cctgatgcct catctgcagg gtcctgtgcc
3541 tctgaagttc tagccatgag gtttccaggt aggacagctg ctccccaagc ctcctgagga
```

TABLE 1-continued

```
3601 cacaggaaga gacggaagga gcaccttgac agacttgtgt gagtcttctc gaaggagggt
3661 tgactcagaa cccagagaca atacaaaacc cctcacttcc tctgagaggg ccaaatgctg
3721 tgagtctgaa gtatgtgcct ggtgtgaaat gatctatggc ctgtttctta cacaggaagc
3781 cccctgaacc tcctgtacat gtgttcatgt tcccagccag ctctgagacc caggaaccaa
3841 atattccatt ttggcttctg ctagagcagt catggttcct ctcctaaaag ccatgggcag
3901 cagtttccga gggcctgcat gatccacctg ctgcacgatc ctatgagggc ttcctgtggc
3961 acacagccct ctgggtgctt gggaactagc ttcaggcaca gcctgattct ggtgatccag
4021 tgatctatgg aagtcgtgtc ttactccagg tgaaggggga aaaaaaaagc ctatactttg
4081 gcaggttatg aactttgaat gtgatgaaat gacacgtttg gctgcatttg gatggtgtct
4141 tagaaccctc attgctcaga cctgaaggct acttctagga gcatgaagtt tgagttttgt
4201 gtttttccaa aggatacttc cttggccctt tttctttatt gactagacca ccagaggagg
4261 atgtgtggga ttgtaggcaa acccacctgt ggcatcactg aaaataaatt tgatcatacc
4321 taagaggtta ggaaatggtg ccattcccac cttagagtgc tacataggtg ctttgggcgt
4381 atgtaacatt agtgtccttc cttgaagcca caagctagtt ttcttagttt taaaatcctg
4441 ttgtatgaat ggcatttgta tattaaaaca cttttttaaa ggacagttga aaagggcaag
4501 aggaaaccag ggcagttcta gaggagtgct ggtgactgga tagcagtttt aagtggcgtt
4561 cacctagtca acacgaccgc gtgtgttgcc cctgccctgg gctccccgcc atgacatctt
4621 caccttgcag cttgtgctga gactgaccca agtgcagcta gcactgggac acagatcctt
4681 gtcttcagca ccttccaagg agccaacttt tattcccttt cctctctccc ctccccacct
4741 cgcttcttcc caatttagta acttagatgc ttccagcaca tacgtaggta gctaccccag
4801 ccggtttgga ttacaggcct gtgctggaac atcatctcag ttggccacct tcctggcagg
4861 ctgtagacct gacattttga gacaagccta gaggagtcag gagcagggac tttgactctt
4921 aggaagagca cacatgaggg caaggctgct ggcagacgtc tccattgtcc ttatgttgtc
4981 tgtgttgtat tttttttttt ttattgacca tggtgattat ttttttaaac catcgttaat
5041 atactgaagt gagctatagc acatatcatg tgcttagttt gtttattttt ctccatctcc
5101 ccttggcttc ctagagtttg gacatattcc aggctaaatg cttttactca agactacaga
5161 aaggtttgaa gtagtgtgtg catggcatgc acgtatgtaa gtaatctggg gaagaagcaa
5221 agatctgttt cattcttagc ctcaggcctc atgagggtct ccacagggcc ggagctcagg
5281 ttacaccact ccttcgtcct tacaggagat gtagggagaa gaatctgcag gctgcttgta
5341 ggactgttca ccaaggggga taccagcagc aagagagtgc acccgtttag ccctggaccc
5401 tgtttcttac tgtgtgactt ggctagagtt gggagttccc ccaaaataaa cgtgtcccca
5461 ttttaccaga accaaacctc aacacagcga agctgtactg tctttgtgtg gcaaagatgt
5521 tcccttgtag gccccctttca ggtaaccgtc ttcacaatgt attttcatca cagtttaagg
5581 agcatcagcc gcttctcaag tgggtaggga aagcagaaaa acgtacgcaa gaggacatgg
5641 atccaaaatg atgatgaagc atctcccatg gggaggtgat ggtggggaga tgatgggcta
5701 aacaggcaac ttttcaaaaa cacagctatc atagaaaaga aacttgcctc atgtaaactg
5761 gattgagaaa ttctcagtga ttctgcaatg gatttttttt taatgcagaa gtaatgtata
5821 ctctagtatt ctggtgtttt tatatttatg taataatttc ttaaaaccat tcagacagat
5881 aactatttaa tttttttttaa gaaagttgga aaggtctctc ctcccaagga cagtggctgg
5941 aagagttggg gcacagccag ttctgaatgt tggtggaggg tgtagtggct ttttggctca
6001 gcatccagaa acaccaaacc aggctggcta aacaagtggc cgcgtgtaaa aacagacagc
6061 tctgagtcaa atctgggccc ttccacaagg gtcctctgaa ccaagcccca ctcccttgct
6121 aggggtgaaa gcattacaga gagatggagc catctatcca agaagccttc actcaccttc
6181 actgctgctg ttgcaactcg gctgttctgg actctgatgt gtgtggaggg atggggaata
6241 gaacattgac tgtgttgatt accttcacta ttcggccagc ctgacctttt aataactttg
6301 taaaaagcat gtatgtattt atagtgtttt agatttttct aactttttata tcttaaaagc
6361 agagcacctg tttaagcatt gtacccctat tgttaaagat ttgtgtcctc tcattccctc
6421 tcttcctctt gtaagtgccc ttctaataaa cttttcatgg aaaa
```

SEQ ID NO: 146 Human SMAD3 isoform 1 amino acid sequence (NP_005893.1)

```
  1 mssilpftpp ivkrllgwkk geqngqeekw cekavkslvk klkktgqlde lekaittqnv
 61 ntkcitiprs ldgrlqvshr kglphviycr lwrwpdlhsh helramelce fafnmkkdev
121 cvnpyhyqrv etpvlppvlv prhteipaef ppldydyshsi pentnfpagi epqsnipetp
181 ppgylsedge tsdhqmnhsm dagspnlspn pmspahnnld lqpvtycepa fwcsisyyel
241 nqrvgetfha sqpsmtvdgf tdpsnserfc lgllsnvnrn aaveltrrhi grgvrlyyig
301 gevfaeclsd saifvqspnc nqrygwhpat vckippgcnl kifnnqefaa llaqsvnqgf
361 eavyqltrmc tirmsfvkgw gaeyrrqtvt stpcwielhl ngplqwldkv ltqmgspsir
421 cssvs
```

SEQ ID NO: 147 Human SMAD3 transcript variant 2 cDNA sequence (NM_001145102.1; CDS: 379-1341)

```
   1 aaatatgagc ttgtgcttgc tggaggagga tgacagagga gcctgctgct gagttcactg
  61 gtgctggggt taggtcactg ctgggctgaa gcgcactgac cataagagca acatgtgggc
 121 aagagccgcg gcactggggt aatttattgc cgccgctcgc ttcaccagga accccacacg
 181 ctgggttccc acaggatgcg acattcccac aggatgggac aactgcatgg aaacccacac
 241 tcgggcctgt gttgagcaac cacgtttgag tccctggatg gccggttgca ggtgtcccat
 301 cggaaggggc tccctcatgt catctactgc cgcctgtggc gatggccaga cctgcacagc
 361 caccacgagc tacgggccat ggagctgtgt gagttcgcct tcaatatgaa gaaggacgag
 421 gtctgcgtga atccctacca ctaccagaga gtagagacac cagttctacc tcctgtgttg
 481 gtgccacgcc acacagagat cccggccgag ttccccccac tggacgacta cagccattcc
 541 atccccgaaa acactaactt ccccgcaggc atcgagcccc agagcaatat tccagagacc
 601 ccacccccctg gctacctgag tgaagatgga gaaaccagtg accaccagat gaaccacagc
 661 atggacgcag gttctccaaa cctatccccg aatccgatgt ccccagcaca taataacttg
 721 gacctgcagc cagttaccta ctgcgagccg gccttctggt gctccatctc ctactacgag
 781 ctgaaccagc gcgtcgggga gacattccac gcctcgcagc catccatgac tgtggatggc
 841 ttcaccgacc cctccaattc ggagcgcttc tgcctagggc tgctctccaa tgtcaacagg
 901 aatgcagcag tggagctgac acggagacac atcggaagag gcgtgcggct ctactacatc
 961 ggaggggagg tcttcgcaga gtgcctcagt gacagcgcta tttttgtcca gtctcccaac
1021 tgtaaccagc gctatggctg gcacccggcc accgtctgca agatcccacc aggatgcaac
1081 ctgaagatct tcaacaacca ggagttcgct gccctcctgg cccagtcggt caaccagggc
```

TABLE 1-continued

```
1141 tttgaggctg tctaccagtt gacccgaatg tgcaccatcc gcatgagctt cgtcaaaggc
1201 tggggagcgg agtacaggag acagactgtg accagtaccc cctgctggat tgagctgcac
1261 ctgaatgggc ctttgcagtg gcttgacaag gtcctcaccc agatgggctc cccaagcatc
1321 cgctgttcca gtgtgtctta gagacatcaa gtatggtagg ggagggcagg cttggggaaa
1381 atggccatgc aggaggtgga gaaaattgga actctactca acccattgtt gtcaaggaag
1441 aagaaatctt tctccctcaa ctgaaggggt gcacccacct gttttctgaa acacacgagc
1501 aaacccagag gtggatgtta tgaacagctg tgtctgccaa acacatttac cctttggccc
1561 cactttgaag ggcaagaaat ggcgtctgct ctggtggctt aagtgagcag aacaggtagt
1621 attacaccac cggccccctc cccccagact cttttttga gtgacagctt tctgggatgt
1681 cacagtccaa ccagaaacac ccctctgtct aggactgcag tgtggagttc accttggaag
1741 ggcgttctag gtaggaagag cccgcagggc catgcagacc tcatgcccag ctctctgacg
1801 cttgtgacag tgcctcttcc agtgaacatt cccagcccag ccccgccccg ccccgcccca
1861 ccactccagc agaccttgcc ccttgtgagc tggatagact tgggatgggg agggagggag
1921 ttttgtctgt ctccctcccc tctcagaaca tactgattgg gaggtgcgtg ttcagcagaa
1981 cctgcacaca ggacagcggg aaaaatcgat gagcgccacc tctttaaaaa ctcacttacg
2041 tttgtccttt ttcactttga aaagttggaa ggatctgctg aggcccagtg catatgcaat
2101 gtatagtgtc tattatcaca ttaatctcaa agagattcga atgacggtaa gtgttctcat
2161 gaagcaggag gcccttgtcg tgggatggca tttggtctca ggcagcacca cactgggtgc
2221 gtctccagtc atctgtaaga gcttgctcca gattctgatg catacggcta tattggttta
2281 tgtagtcagt tgcattcatt aaatcaactt tatcatatgc tcttttaaat gtttggttta
2341 tatattttct ttaaaaatcc tgggctggca cattgactgg gaaacctgag tgagacccag
2401 caactgcttc tctcccttct ctctcctgag gtgaagcttt tccaggtttt gttgaagaga
2461 tacctgccag cacttctgca agctgaaatt tacagaagca aattcaccag aagggaaaca
2521 tctcaggcca acataggcaa atgaaaaggg ctattaaaat atttttacac ctttgaaaat
2581 tgcaggcttg gtacaaagag gtctgtcatc ttccccctgg gatataagat gatctagctc
2641 ccggtagagg atcaccggtg acaactatag cagttgtatt gtgtaacaag tactgctccc
2701 agcagcaatt agggagaaaa ctagtctaaa ttatttcaac tggaaaaaag aaaaaagagt
2761 cctcttcttt tcccagcctt ttgcagaaca cagtagacag aactgccacc ttcaattggt
2821 actttattct ttgctgctgt ttttgtataa aatgacctat cccacgtttt tgcatgaatt
2881 tatagcagga aaaatcaagg gatttcctat ggaagtcctg ctttattcca ggtgaaggga
2941 aggaagtgta tatacttttg gcaagtcata cagctcaaat gtgatgagat ttctgatgtt
3001 agagggagat ggagaggctt cctgatgcct catctgcagg gtcctgtgcc tctgaagttc
3061 tagccatgag gtttccaggt aggacagctg ctccccaagc ctcctgagga cacaggaaga
3121 gacggaagga gcaccttgac agacttgtgt gagtcttctc gaaggagggt tgactcagaa
3181 cccagagaca atacaaaacc cctcacttcc tctgagaggg ccaaatgctg tgagtctgaa
3241 gtatgtgcct ggtgtgaaat gatctatggc ctgtttctta cacaggaagc cccctgaacc
3301 tcctgtacat gtgttcatgt tcccagccag ctctgagacc caggaaccaa atattccatt
3361 ttggcttctg ctagagcagt catggttcct ctcctaaaag ccatgggcag cagtttccga
3421 gggcctgcat gatccacctg ctgcacgatc ctatgagggc ttcctgtggc acacagccct
3481 ctgggtgctt gggaactagc ttcaggcaca gcctgattct ggtgatccag tgatctatgg
3541 aagtcgtgtc ttactccagg tgaaggggga aaaaaaaagc ctatactttg gcaggttatg
3601 aactttgaat gtgatgaaat gacacgtttg gctgcatttg gatggtgtct tagaaccctc
3661 attgctcaga cctgaaggct acttctagga gcatgaagtt tgagttttgt gtttttccaa
3721 aggatacttc cttggccctt tttctttatt gactagacca ccagaggagg atgtgtggga
3781 ttgtaggcaa acccacctgt ggcatcactg aaaataaatt tgatcatacc taagaggtta
3841 ggaaatggtg ccattcccac cttagagtgc tacataggtg ctttgggcgt atgtaacatt
3901 agtgtccttc cttgaagcca caagctagtt ttcttagttt taaaatcctg ttgtatgaat
3961 ggcatttgta tattaaaaca ctttttaaa ggacagttga aaagggcaag aggaaaccag
4021 ggcagttcta gaggagtgct ggtgactgga tagcagtttt aagtggcgtt cacctagtca
4081 acacgaccgc gtgtgttgcc cctgccctgg gctccccgcc atgacatctt caccttgcag
4141 cttgtgctga gactgaccca agtgcagcta gcactgggac acagatcctt gtcttcagca
4201 ccttccaagg agccaacttt tattcccttt cctctctccc ctccccacct cgcttcttcc
4261 caatttagta acttagatgc ttccagcaca tacgtaggta gctaccccag ccggtttgga
4321 ttacaggcct gtgctggaac atcatctcag ttggccacct tcctggcagg ctgtagacct
4381 gacattttga gacaagccta gagtcaggag cagggacttt gactcttagg aagagcacac
4441 atgagggcaa ggctgctggc agacgtctcc attgtcctta tgttgtctgt gttgtatttt
4501 tttttttta ttgaccatgg tgattatttt tttaaaccat cgttaatata ctgaagtgag
4561 ctatagcaca tatcatgtgc ttagtttgtt tatttttctc catctcccct tggcttccta
4621 gagtttggac atattccagg ctaaatgctt ttactcaaga ctacagaaag gtttgaagta
4681 gtgtgtgcat ggcatgcacg tatgtaagta atctggggaa gaagcaaaga tctgtttcat
4741 tcttagcctc aggcctcatg agggtctcca cagggccgga gctcaggtta caccactcct
4801 tcgtccttac aggagatgta gggagaagaa tctgcaggct gcttgtagga ctgttcacca
4861 agggggatac cagcagcaag agagtgcacc cgtttagccc tggaccctgt ttcttactgt
4921 gtgacttggc tagagttggg agttccccca aaataaacgt gtccccattt taccagaacc
4981 aaacctcaac acagcgaagc tgtactgtct ttgtgtggca aagatgttcc cttgtaggcc
5041 cctttcaggt aaccgtcttc acaatgtatt ttcatcacag tttaaggagc atcagccgct
5101 tctcaagtgg gtagggaaag cagaaaaacg tacgcaagag gacatggatc caaaatgatg
5161 atgaagcatc tcccatgggg aggtgatggt ggggagatga tgggctaaac aggcaacttt
5221 tcaaaaacac agctatcata gaaaagaaac ttgcctcatg taaactggat tgagaaattc
5281 tcagtgattc tgcaatggat tttttttaa tgcagaagta atgtatactc tagtattctg
5341 gtgtttttat atttatgtaa taatttctta aaaccattca gacagataac tatttaattt
5401 tttttaagaa agttggaaag gtctctcctc ccaaggacag tggctggaag agttggggca
5461 cagccagttc tgaatgttgg tggagggtgt agtggctttt tggctcagca tccagaaaca
5521 ccaaaccagg ctggctaaac aagtggccgc gtgtaaaaac agacagctct gagtcaaatc
5581 tgggcccttc cacaagggtc ctctgaacca agccccactc ccttgctagg ggtgaaagca
5641 ttacagagag atggagccat ctatccaaga agccttcact caccttcact gctgctgttg
5701 caactcggct gttctggact ctgatgtgtg tggagggatg gggaatagaa cattgactgt
```

TABLE 1-continued

```
5761 gttgattacc ttcactattc ggccagcctg accttttaat aactttgtaa aaagcatgta
5821 tgtatttata gtgttttaga tttttctaac ttttatatct taaaagcaga gcacctgttt
5881 aagcattgta cccctattgt taaagatttg tgtcctctca ttccctctct tcctcttgta
5941 agtgcccttc taataaactt ttcatggaaa agctcctgtg ccaggagctc agtctga
```

SEQ ID NO: 148 Human SMAD3 isoform 2 amino acid sequence (NP_001138574.1)

```
  1 melcefafnm kkdevcvnpy hyqrvetpvl ppvlvprhte ipaefppldd yshsipentn
 61 fpagiepqsn ipetpppgyl sedgetsdhq mnhsmdagsp nlspnpmspa hnnldlqpvt
121 ycepafwcsi syyelnqrvg etfhasqpsm tvdgftdpsn serfclglls nvnrnaavel
181 trrhigrgvr lyyiggevfa eclsdsaifv qspncnqryg whpatvckip pgcnlkifnn
241 qefaallaqs vnqgfeavyq ltrmctirms fvkgwgaeyr rqtvtstpcw ielhlngplq
301 wldkvltqmg spsircssvs
```

SEQ ID NO: 149 Human SMAD3 transcript variant 3 cDNA sequence (NM_001145103.1; CDS: 7-1152)

```
   1 acaaacatgt cttgcctgca ccctaggcaa acgtggaaag gcgcagctct ggtacaccgg
  61 aaagcatggt ggatggggag gtccctggat ggccggttgc aggtgtccca tcggaagggg
 121 ctccctcatg tcatctactg ccgcctgtgg cgatggccag acctgcacag ccaccacgag
 181 ctacgggcca tggagctgtg tgagttcgcc ttcaatatga agaaggacga ggtctgcgtg
 241 aatccctacc actaccagag agtagagaca ccagttctac ctcctgtgtt ggtgccacgc
 301 cacacagaga tcccggccga gttcccccca ctggacgact acagccattc catccccgaa
 361 aacactaact tccccgcagg catcgagccc cagagcaata ttccagagac cccaccccct
 421 ggctacctga gtgaagatgg agaaaccagt gaccaccaga tgaaccacag catggacgca
 481 ggttctccaa acctatcccc gaatccgatg tccccagcac ataataactt ggacctgcag
 541 ccagttacct actgcgagcc ggccttctgg tgctccatct cctactacga gctgaaccag
 601 cgcgtcgggg agacattcca cgcctcgcag ccatccatga ctgtggatgg cttcaccgac
 661 ccctccaatt cggagcgctt ctgcctaggg ctgctctcca atgtcaacag gaatgcagca
 721 gtggagctga cacggagaca catcggaaga ggcgtgcggc tctactacat cggaggggag
 781 gtcttcgcag agtgcctcag tgacagcgct atttttgtcc agtctcccaa ctgtaaccag
 841 cgctatggct ggcaccaggc caccgtctgc aagatcccac caggatgcaa cctgaagatc
 901 ttcaacaacc aggagttcgc tgccctcctg gcccagtcgg tcaaccaggg ctttgaggct
 961 gtctaccagt tgacccgaat gtgcaccatc cgcatgagct tcgtcaaagg ctggggagcg
1021 gagtacagga gacagactgt gaccagtacc ccctgctgga ttgagctgca cctgaatggg
1081 cctttgcagt ggcttgacaa ggtcctcacc cagatgggct ccccaagcat ccgctgttcc
1141 agtgtgtctt agagacatca agtatggtag gggagggcag gcttggggaa aatggccatg
1201 caggaggtgg agaaaattgg aactctactc aacccattgt tgtcaaggaa gaagaaatct
1261 ttctccctca actgaagggg tgcacccacc tgttttctga aacacacgag caaacccaga
1321 ggtggatgtt atgaacagct gtgtctgcca aacacattta ccctttggcc ccactttgaa
1381 gggcaagaaa tggcgtctgc tctggtggct taagtgagca gaacaggtag tattacacca
1441 ccggcccccct cccccccagac tcttttttttg agtgacagct ttctgggatg tcacagtcca
1501 accagaaaca cccctctgtc taggactgca gtgtggagtt caccttggaa gggcgttcta
1561 ggtaggaaga gcccgcaggg ccatgcagac ctcatgccca gctctctgac gcttgtgaca
1621 gtgcctcttc cagtgaacat tcccagccca gccccgcccc gccccgcccc accactccag
1681 cagaccttgc cccttgtgag ctggatagac ttgggatggg gagggaggga gttttgtctg
1741 tctccctccc ctctcagaac atactgattg ggaggtgcgt gttcagcaga acctgcacac
1801 aggacagcgg gaaaaatcga tgagcgccac ctctttaaaa actcacttac gtttgtcctt
1861 tttcactttg aaaagttgga aggatctgct gaggcccagt gcatatgcaa tgtatagtgt
1921 ctattatcac attaatctca aagagattcg aatgacggta agtgttctca tgaagcagga
1981 ggcccttgtc gtgggatggc atttggtctc aggcagcacc acactgggtg cgtctccagt
2041 catctgtaag agcttgctcc agattctgat gcatacggct atattggttt atgtagtcag
2101 ttgcattcat taaatcaact ttatcatatg ctcttttaaa tgtttggttt atatattttc
2161 tttaaaaatc ctgggctggc acattgactg ggaaacctga gtgagaccca gcaactgctt
2221 ctctcccttc tctctcctga ggtgaagctt ttccaggttt tgttgaagag atacctgcca
2281 gcacttctgc aagctgaaat ttacagaagc aaattcacca gaagggaaac atctcaggcc
2341 aacataggca aatgaaaagg gctattaaaa tatttttaca cctttgaaaa ttgcaggctt
2401 ggtacaaaga ggtctgtcat cttcccccctg ggatataaga tgatctagct cccggtagag
2461 gatcaccggt gacaactata gcagttgtat tgtgtaacaa gtactgctcc cagcagcaat
2521 tagggagaaa actagtctaa attatttcaa ctggaaaaaa gaaaaaagag tcctcttctt
2581 ttcccagcct tttgcagaac acagtagaca gaactgccac cttcaattgg tactttattc
2641 tttgctgctg tttttgtata aaatgaccta tcccacgttt ttgcatgaat ttatagcagg
2701 aaaaatcaag ggatttccta tggaagtcct gctttattcc aggtgaaggg aaggaagtgt
2761 atatactttt ggcaagtcat acagctcaaa tgtgatgaga tttctgatgt tagagggaga
2821 tggagaggct tcctgatgcc tcatctgcag ggtcctgtgc ctctgaagtt ctagccatga
2881 ggtttccagg taggacagct gctccccaag cctcctgagg acacaggaag agacggaagg
2941 agcaccttga cagacttgtg tgagtcttct cgaaggaggg ttgactcaga acccagagac
3001 aatacaaaac ccctcacttc ctctgagagg gccaaatgct gtgagtctga agtatgtgcc
3061 tggtgtgaaa tgatctatgg cctgtttctt acacaggaag ccccctgaac ctcctgtaca
3121 tgtgttcatg ttcccagcca gctctgagac ccaggaacca aatattccat tttggcttct
3181 gctagagcag tcatggttcc tctcctaaaa gccatgggca gcagtttccg agggcctgca
3241 tgatccacct gctgcacgat cctatgaggg cttcctgtgg cacacagccc tctgggtgct
3301 tgggaactag cttcaggcac agcctgattc tggtgatcca gtgatctatg gaagtcgtgt
3361 cttactccag gtgaaggggg aaaaaaaaag cctatacttt ggcaggttat gaactttgaa
3421 tgtgatgaaa tgacacgttt ggctgcattt ggatggtgtc ttagaaccct cattgctcag
3481 acctgaaggc tacttctagg agcatgaagt ttgagttttg tgtttttcca aaggatactt
3541 ccttggccct ttttctttat tgactagacc accagaggag gatgtgtggg attgtaggca
3601 aacccacctg tggcatcact gaaaataaat ttgatcatac ctaagaggtt aggaaatggt
3661 gccattccca ccttagagtg ctacataggt gctttgggcg tatgtaacat tagtgtcctt
3721 ccttgaagcc acaagctagt tttcttagtt ttaaaatcct gttgtatgaa tggcatttgt
3781 atattaaaac actttttaa aggacagttg aaaagggcaa gaggaaacca gggcagttct
3841 agaggagtgc tggtgactgg atagcagttt taagtggcgt tcacctagtc aacacgaccg
```

TABLE 1-continued

```
3901 cgtgtgttgc ccctgccctg ggctccccgc catgacatct tcaccttgca gcttgtgctg
3961 agactgaccc aagtgcagct agcactggga cacagatcct tgtcttcagc accttccaag
4021 gagccaactt ttattccctt tcctctctcc cctccccacc tcgcttcttc ccaatttagt
4081 aacttagatg cttccagcac atacgtaggt agctacccca gccggtttgg attacaggcc
4141 tgtgctggaa catcatctca gttggccacc ttcctggcag gctgtagacc tgacattttg
4201 agacaagcct agagtcagga gcagggactt tgactcttag gaagagcaca catgagggca
4261 aggctgctgg cagacgtctc cattgtcctt atgttgtctg tgttgtattt ttttttttt
4321 attgaccatg gtgattattt ttttaaacca tcgttaatat actgaagtga gctatagcac
4381 atatcatgtg cttagtttgt ttatttttct ccatctcccc ttggcttcct agagtttgga
4441 catattccag gctaaatgct tttactcaag actacagaaa ggtttgaagt agtgtgtgca
4501 tggcatgcac gtatgtaagt aatctgggga agaagcaaag atctgtttca ttcttagcct
4561 caggcctcat gagggtctcc acagggccgg agctcaggtt acaccactcc ttcgtcctta
4621 caggagatgt agggagaaga atctgcaggc tgcttgtagg actgttcacc aagggggata
4681 ccagcagcaa gagagtgcac ccgtttagcc ctggaccctg tttcttactg tgtgacttgg
4741 ctagagttgg gagttccccc aaaataaacg tgtccccatt ttaccagaac caaacctcaa
4801 cacagcgaag ctgtactgtc tttgtgtggc aaagatgttc ccttgtaggc ccctttcagg
4861 taaccgtctt cacaatgtat tttcatcaca gtttaaggag catcagccgc ttctcaagtg
4921 ggtagggaaa gcagaaaaac gtacgcaaga ggacatggat ccaaaatgat gatgaagcat
4981 ctcccatggg gaggtgatgg tggggagatg atgggctaaa caggcaactt ttcaaaaaca
5041 cagctatcat agaaaagaaa cttgcctcat gtaaactgga ttgagaaatt ctcagtgatt
5101 ctgcaatgga tttttttta atgcagaagt aatgtatact ctagtattct ggtgttttta
5161 tatttatgta ataatttctt aaaaccattc agacagataa ctatttaatt tttttaaga
5221 aagttggaaa ggtctctcct cccaaggaca gtggctggaa gagttggggc acagccagtt
5281 ctgaatgttg gtggagggtg tagtggcttt ttggctcagc atccagaaac accaaaccag
5341 gctggctaaa caagtggccg cgtgtaaaaa cagacagctc tgagtcaaat ctgggccctt
5401 ccacaagggt cctctgaacc aagccccact cccttgctag gggtgaaagc attacagaga
5461 gatggagcca tctatccaag aagccttcac tcaccttcac tgctgctgtt gcaactcggc
5521 tgttctggac tctgatgtgt gtggagggat ggggaataga acattgactg tgttgattac
5581 cttcactatt cggccagcct gacctttttaa taactttgta aaaagcatgt atgtatttat
5641 agtgttttag atttttctaa cttttatatc ttaaaagcag agcacctgtt taagcattgt
5701 acccctattg ttaaagattt gtgtcctctc attccctctc ttcctcttgt aagtgccctt
5761 ctaataaact tttcatggaa aagctcctgt gccaggagct cagtctga
```

SEQ ID NO: 150 Human SMAD3 isoform 3 amino acid sequence (NP_001138575.1)

```
  1 msclhprqtw kgaalvhrka wwmgrsldgr lqvshrkglp hviycrlwrw pdlhshhelr
 61 amelcefafn mkkdevcvnp yhyqrvetpv lppvlvprht eipaefppld dyshsipent
121 nfpagiepqs nipetpppgy lsedgetsdh qmnhsmdags pnlspnpmsp ahnnldlqpv
181 tycepafwcs isyyelnqrv getfhasqps mtvdgftdps nserfclgll snvnrnaave
241 ltrrhigrgv rlyyiggevf aeclsdsaif vqspncnqry gwhpatvcki ppgcnlkifn
301 nqefaallaq svnqgfeavy qltrmctirm sfvkgwgaey rrqtvtstpc wielhlngpl
361 qwldkvltqm gspsircssv s
```

SEQ ID NO: 151 Human SMAD3 transcript variant 4 cDNA sequence
(NM_001145104.1; CDS: 93-785)

```
   1 cttctcagat cctttgcggg tagccctggc gtcccgcgga gaccccaccc cctggctacc
  61 tgagtgaaga tggagaaacc agtgaccacc agatgaacca cagcatggac gcaggttctc
 121 caaacctatc cccgaatccg atgtccccag cacataataa cttggacctg cagccagtta
 181 cctactgcga gccggccttc tggtgctcca tctcctacta cgagctgaac cagcgcgtcg
 241 gggagacatt ccacgcctcg cagccatcca tgactgtgga tggcttcacc gacccctcca
 301 attcggagcg cttctgccta gggctgctct ccaatgtcaa caggaatgca gcagtggagc
 361 tgacacggag acacatcgga agaggcgtgc ggctctacta catcggaggg gaggtcttcg
 421 cagagtgcct cagtgacagc gctatttttg tccagtctcc caactgtaac cagcgctatg
 481 gctggcaccc ggccaccgtc tgcaagatcc caccaggatg caacctgaag atcttcaaca
 541 accaggagtt cgctgccctc ctggcccagt cggtcaacca gggctttgag gctgtctacc
 601 agttgacccg aatgtgcacc atccgcatga gcttcgtcaa aggctgggga gcggagtaca
 661 ggagacagac tgtgaccagt accccctgct ggattgagct gcacctgaat gggcctttgc
 721 agtggcttga caaggtcctc acccagatgg gctccccaag catccgctgt tccagtgtgt
 781 cttagagaca tcaagtatgg taggggaggg caggcttggg gaaaatggcc atgcaggagg
 841 tggagaaaat tggaactcta ctcaacccat tgttgtcaag gaagaagaaa tctttctccc
 901 tcaactgaag ggtgcaccc acctgttttc tgaaacacac gagcaaaccc agaggtggat
 961 gttatgaaca gctgtgtctg ccaaacacat ttaccctttg gccccacttt gaagggcaag
1021 aaatggcgtc tgctctggtg gcttaagtga gcagaacagg tagtattaca ccaccggccc
1081 cctccccccca gactcttttt ttgagtgaca gctttctggg atgtcacagt ccaaccagaa
1141 acacccctct gtctaggact gcagtgtgga gttcaccttg gaagggcgtt ctaggtagga
1201 agagcccgca gggccatgca gacctcatgc ccagctctct gacgcttgtg acagtgcctc
1261 ttccagtgaa cattcccagc ccagccccgc cccgccccgc cccaccactc cagcagacct
1321 tgccccttgt gagctggata gacttgggat ggggagggag ggagttttgt ctgtctccct
1381 cccctctcag aacatactga ttgggaggtg cgtgttcagc agaacctgca cacaggacag
1441 cgggaaaaat cgatgagcgc cacctcttta aaaactcact tacgtttgtc ctttttcact
1501 ttgaaaagtt ggaaggatct gctgaggccc agtgcatatg caatgtatag tgtctattat
1561 cacattaatc tcaaagagat tcgaatgacg gtaagtgttc tcatgaagca ggaggccctt
1621 gtcgtgggat ggcatttggt ctcaggcagc accacactgg gtgcgtctcc agtcatctgt
1681 aagagcttgc tccagattct gatgcatacg gctatattgg tttatgtagt cagttgcatt
1741 cattaaatca actttatcat atgctctttt aaatgtttgg tttatatatt ttctttaaaa
1801 atcctgggct ggcacattga ctgggaaacc tgagtgagac ccagcaactg cttctctccc
1861 ttctctctcc tgaggtgaag cttttccagg ttttgttgaa gagatacctg ccagcacttc
1921 tgcaagctga aatttacaga agcaaattca ccagaaggga aacatctcag gccaacatag
1981 gcaaatgaaa agggctatta aaatattttt acacctttga aaattgcagg cttggtacaa
2041 agaggtctgt catcttcccc ctgggatata agatgatcta gctcccggta gaggatcacc
2101 ggtgacaact atagcagttg tattgtgtaa caagtactgc tcccagcagc aattagggag
```

TABLE 1-continued

```
2161 aaaactagtc taaattattt caactggaaa aaagaaaaaa gagtcctctt cttttcccag
2221 ccttttgcag aacacagtag acagaactgc caccttcaat tggtacttta ttctttgctg
2281 ctgtttttgt ataaaatgac ctatcccacg tttttgcatg aatttatagc aggaaaaatc
2341 aagggatttc ctatggaagt cctgctttat tccaggtgaa gggaaggaag tgtatatact
2401 tttggcaagt catacagctc aaatgtgatg agatttctga tgttagaggg agatggagag
2461 gcttcctgat gcctcatctg cagggtcctg tgcctctgaa gttctagcca tgaggtttcc
2521 aggtaggaca gctgctcccc aagcctcctg aggacacagg aagagacgga aggagcacct
2581 tgacagactt gtgtgagtct tctcgaagga gggttgactc agaacccaga gacaatacaa
2641 aacccctcac ttcctctgag agggccaaat gctgtgagtc tgaagtatgt gcctggtgtg
2701 aaatgatcta tggcctgttt cttacacagg aagccccctg aacctcctgt acatgtgttc
2761 atgttcccag ccagctctga gacccaggaa ccaaatattc cattttggct tctgctagag
2821 cagtcatggt tcctctccta aaagccatgg gcagcagttt ccgagggcct gcatgatcca
2881 cctgctgcac gatcctatga gggcttcctg tggcacacag ccctctgggt gcttgggaac
2941 tagcttcagg cacagcctga ttctggtgat ccagtgatct atggaagtcg tgtcttactc
3001 caggtgaagg gggaaaaaaa aagcctatac tttggcaggt tatgaacttt gaatgtgatg
3061 aaatgacacg tttggctgca tttggatggt gtcttagaac cctcattgct cagacctgaa
3121 ggctacttct aggagcatga agtttgagtt ttgtgttttt ccaaaggata cttccttggc
3181 ccttttcttt tattgactag accaccagag gaggatgtgt gggattgtag gcaaacccac
3241 ctgtggcatc actgaaaata aatttgatca tacctaagag gttaggaaat ggtgccattc
3301 ccaccttaga gtgctacata ggtgctttgg gcgtatgtaa cattagtgtc cttccttgaa
3361 gccacaagct agtttctta gttttaaaat cctgttgtat gaatggcatt tgtatattaa
3421 aacacttttt taaaggacag ttgaaaaggg caagaggaaa ccagggcagt tctagaggag
3481 tgctggtgac tggatagcag ttttaagtgg cgttcaccta gtcaacacga ccgcgtgtgt
3541 tgcccctgcc ctgggctccc cgccatgaca tcttcacctt gcagcttgtg ctgagactga
3601 cccaagtgca gctagcactg ggacacagat ccttgtcttc agcaccttcc aaggagccaa
3661 cttttattcc ctttcctctc tcccctcccc acctcgcttc ttcccaattt agtaacttag
3721 atgcttccag cacatacgta ggtagctacc ccagccggtt tggattacag gcctgtgctg
3781 gaacatcatc tcagttggcc accttcctgg caggctgtag acctgacatt ttgagacaag
3841 cctagagtca ggagcaggga ctttgactct taggaagagc acacatgagg gcaaggctgc
3901 tggcagacgt ctccattgtc cttatgttgt ctgtgttgta tttttttttt tttattgacc
3961 atggtgatta tttttttaaa ccatcgttaa tatactgaag tgagctatag cacatatcat
4021 gtgcttagtt tgtttatttt tctccatctc cccttggctt cctagagttt ggacatattc
4081 caggctaaat gcttttactc aagactacag aaaggtttga agtagtgtgt gcatggcatg
4141 cacgtatgta agtaatctgg ggaagaagca aagatctgtt tcattcttag cctcaggcct
4201 catgagggtc tccacagggc cggagctcag gttacaccac tccttcgtcc ttacaggaga
4261 tgtagggaga agaatctgca ggctgcttgt aggactgttc accaaggggg ataccagcag
4321 caagagagtg cacccgttta gccctggacc ctgtttctta ctgtgtgact tggctagagt
4381 tgggagttcc cccaaaataa acgtgtcccc attttaccag aaccaaacct caacacagcg
4441 aagctgtact gtctttgtgt ggcaaagatg ttcccttgta ggccccttc aggtaaccgt
4501 cttcacaatg tattttcatc acagtttaag gagcatcagc cgcttctcaa gtgggtaggg
4561 aaagcagaaa aacgtacgca agaggacatg gatccaaaat gatgatgaag catctcccat
4621 ggggaggtga tggtggggag atgatgggct aaacaggcaa cttttcaaaa acacagctat
4681 catagaaaag aaacttgcct catgtaaact ggattgagaa attctcagtg attctgcaat
4741 ggattttttt ttaatgcaga agtaatgtat actctagtat tctggtgttt ttatatttat
4801 gtaataattt cttaaaacca ttcagacaga taactattta atttttttta agaaagttgg
4861 aaaggtctct cctcccaagg acagtggctg gaagagttgg ggcacagcca gttctgaatg
4921 ttggtggagg gtgtagtggc tttttggctc agcatccaga aacaccaaac caggctggct
4981 aaacaagtgg ccgcgtgtaa aaacagacag ctctgagtca aatctgggcc cttccacaag
5041 ggtcctctga accaagcccc actcccttgc taggggtgaa agcattacag agagatggag
5101 ccatctatcc aagaagcctt cactcacctt cactgctgct gttgcaactc ggctgttctg
5161 gactctgatg tgtgtggagg gatggggaat agaacattga ctgtgttgat taccttcact
5221 attcggccag cctgaccttt taataacttt gtaaaaagca tgtatgtatt tatagtgttt
5281 tagattttc taactttat atcttaaaag cagagcacct gtttaagcat tgtaccccta
5341 ttgttaaaga tttgtgtcct ctcattccct ctcttcctct tgtaagtgcc cttctaataa
5401 acttttcatg gaaaagctcc tgtgccagga gctcagtctg a
```

SEQ ID NO: 152 Human SMAD3 isoform 4 amino acid sequence (NP_001138576.1)

```
  1 mnhsmdagsp nlspnpmspa hnnldlqpvt ycepafwcsi syyelnqrvg etfhasqpsm
 61 tvdgftdpsn serfclglls nvnrnaavel trrhigrgvr lyyiggevfa eclsdsaifv
121 qspncnqryg whpatvckip pgcnlkifnn qefaallaqs vnqgfeavyq ltrmctirms
181 fvkgwgaeyr rqtvtstpcw ielhlngplq wldkvltqmg spsircssvs
```

SEQ ID NO: 153 Mouse SMAD3 cDNA sequence (NM_016769.4; CDS: 318-1595)

```
  1 ggcggcaccc aaacagctac cccgtgcgga aacccaaact ttctactgcc acttggagtc
 61 tcgcggccgc cgcctccgcc ccgcgcgtcc ggggcctgcc cgtcagtccg tcggtccgcg
121 tggagcagct cgggcgccgc cgtgctcccg atccccgcag ctgcagcgcc gcagtcctgg
181 cccggacgcc cgggcaagtt ctccagagtt aaaagcgaag ttcgggcgag gcgcgggccg
241 agctgcctct gagcgccccc ggcgtcccca gtgcgcccag ccccgccggg ggcgccggtg
301 acccttcggt gccagccatg tcgtccatcc tgcccttcac ccccccgatc gtgaagcgcc
361 tgctgggttg gaagaagggc gagcagaacg ggcaggagga gaagtggtgc gagaaggcgg
421 tcaagagctt ggtgaagaag ctcaagaaga cggggcagtt ggacgagctg gagaaggcca
481 tcaccacgca gaacgtgaac accaagtgca ttaccatccc caggtcactg gatggtcggc
541 tgcaggtgtc ccatcggaag gggctccctc acgttatcta ctgccgcctg tggcgatggc
601 ccgacctgca cagccaccat gaattacggg ccatggagct ctgtgagttt gccttcaaca
661 tgaagaagga tgaagtgtgt gtaaatcctt accactatca gagagtagag acgccagttc
721 tacctccagt gttggtgcca cgccacaccg agatcccggc cgagttcccc ccactggatg
781 actacagcca ttccattccc gagaacacta acttccctgc tggcattgag ccccagagca
841 atattccaga aaccccacct cctggctacc tgagtgaaga tggagaaacc agtgaccacc
901 agatgaacca cagcatggac gcaggttctc caaacctctc cccgaatccg atgtccccag
961 cacacaataa cttggaccta cagccagtca cctactgtga gccggccttc tggtgctcca
```

TABLE 1-continued

```
1021 tctcctacta cgagctgaac cagcgagttg gggagacatt ccacgcctca cagccatcca
1081 tgacagtaga tggcttcact gacccctcca actcggagcg cttctgcctg ggcctactgt
1141 ccaatgtcaa ccggaatgca gccgtggaac ttacaaggcg acacattggg agaggtgtgc
1201 ggctctacta catcggaggg gaggtctttg cggagtgcct cagtgacagt gctattttcg
1261 tccagtctcc caactgcaac cagcgctatg gctggcaccc ggccactgtc tgcaagatcc
1321 caccaggctg caacctgaag atcttcaaca accaggaatt tgctgccctc ctagctcagt
1381 ctgtcaacca gggctttgag gctgtctacc agctgacgcg catgtgcacc atccgtatga
1441 gcttcgtcaa aggctgggga gcagagtaca ggagacagac agtgaccagc accccctgct
1501 ggattgagct acacctgaat ggacccttgc agtggcttga caaggtcctc acccagatgg
1561 gttccccgag catccgctgt tccagtgtgt cttagagaca ctaggagtaa agggagcggg
1621 ttggggaggg cgggcttggg gaaaatgacc ttggaagaga actccatcca acttggtctt
1681 gtcaaagaac accgattcca ctcaactaag gcaccagcct gtttctgaga ccacagaaga
1741 aaaccccagg gatggattta tgaacagctg tgtctgctac atacacgtgc ccctgtctga
1801 aggccaagtg atggcttctg ttctggtggc ttgaactaac aggtggtgta tcgccacctg
1861 actccttgtt taatgacaga ggtctgggat gtcacagtcc aaaaggaaag tgcctttctc
1921 catggctgga gtatggagtt tacctttgga gaagttgtaa tggagcatgc cctgtcccac
1981 cactctcaga gagggtgtac ctgtcaaact ggatggccta cataggtact ccccccctacc
2041 cctaggatgc agagagacgg gaacacgccg gagggtagag ctggggagaa cccattcttc
2101 cttggaagga tccgctgaag gtcagcgtat aggtgatgta cagttcctaa tatcacatca
2161 gtctcagagt gttcacagga agcagcaagg gcactcgtgg agtatgtgtc ctgggtgagg
2221 tggcaccaca ccgaatgaat gcatctctgg gagctggcac cacaaccctg atgtataggc
2281 tgtgttggtt tatggagaca agttgcatca atgaattcac ctagcatagg ctctttgaaa
2341 tgtcctctgt ttgataaaaa acaatcctgg gtacgtatgt tggctggaaa accacaatgg
2401 accctgccac tgcttcttgc cctgaggttt ggaagctgag agttatagaa gccaattcac
2461 caggaggtaa gacatcccag gctgacatgg gcaaatgaaa agggctatta aaattttttt
2521 acaccttgga aaattgcagg cttggtgcag agcgctctgt catcttcacc ctgggatgta
2581 ggattaccta gctatggtaa aggattgcca cagcaaactg tgacactgtg taatgagcac
2641 tgttcccagc ggcaattaca gagaaaacga gtgtaaatta tttcaactgg aaaaaagtcc
2701 ctttcttggc tgttttagaa cagggtacac aggatcgcca cctgcaactg gtactcgctt
2761 cttggctgct gcttctgttg tgaaaagacg agcccatgtt tctgcatgga tttcccatgg
2821 aagtcctgtc ctgctacaga ggggaagaaa gtgtaccctc caatgtgata aatcttctga
2881 tgccccccaga ctcttggagc acatcctggt gcccctcctg caggagcctg tggcatattt
2941 ccagctgggc atgctgatcc tccttgagac acagatgcct gtgtgagtct ccgttgatac
3001 aattctgaac ccctcaggtt ctctgaaagg gcacagacca tgggcgtgaa cattgtgccg
3061 tacctgagat ggtctgtgga ctgctgcttc agacacacga gtcctcggaa ctgcctggct
3121 gcctgtcacg catgctctga gtcagaacac accaacgctc tgctgtggct cctagggaag
3181 cattcatggt cctctgttat cagcaggggt ttatgtcact tgctgtccgg tttcctaggg
3241 gcttcctgtg ccccttcccc agctatcctc caggtggcta gggacagtct attctgctgc
3301 aactggaaag tagagggaac cggcactgct cagagcagat ggcggcttct ggaggcacac
3361 agtgggagta caccccttca tgttattggc cagttgctgg agaatgctgt aggagaaaat
3421 tctaggcagg tctactcttg gcatccctga gagtcaaagg cttggagtct aggaaaggtc
3481 acaccatgat ggagaacaca ggtcatttgg gtacgtgtaa tcaaagtgcc ctcccaaatc
3541 agttctcctt ttcgtatgaa cagcatctct acttttaaag aggagttgag gatcgagaag
3601 atgacagtgc agcagtgggt gtggcctgac tacatgtgct gttccagccc tgggtgccca
3661 ctgacaccga cccccaggca gaggcctttg tcttcagcac tcctgagaag ttggctcttt
3721 acccttctc ctctgctgcc cctccttcct gctggttcag gtagccccag ccacgtgggt
3781 tagagtcctg tgctggcctg ccatggcagc tggctacctt ccagaccaac tgtagagata
3841 cctggcattt tgaagaaagc ctagactgga gagcagggcc tctcttggga aggacacaag
3901 gcgggcaagg ctgctggcag acttctccac tgacctgagt gtgctttttt tttccccctaa
3961 atgtattgca tcaagcctca gtgcttatgg agtgcagtgg tcttcatctt ccccaacttg
4021 cttctcagag ctgggatgta ttccagagcc tgatgttttt attcaaacca cagaaaagtt
4081 ttctttaagt agcctgtgca gtcatgcatg tgcctgagtt gtctggagca gaggcaaaca
4141 tctgacttca ttcttagccc caagctgcca tttctgagtc cttgagaggc tgagaaggct
4201 ctagctttgt actgtattct tactgtgtga ctagatgcgt gagcgcttta cattagaagg
4261 aacctggtta gagctcgctc ctcctgtctt tgtgtggcat ttgtgttcca ttaccggccc
4321 ctttaagtaa cggccttcac agcaccttcc cagtgggtag aaagccacac accaggatgt
4381 gggtcaacca tgaagatgtg gcattgcaga cgggggaaca tgtggatgca tggctatcgc
4441 cctgaacagt ccctgcagct acttgtgtta acacagaact gatgtttagc attctgccgc
4501 tttcgtattt atgtaacaat tccttaaagc cattcaaatg gctaactatt taatttcttt
4561 aggacagttg taaaggtctc tctcctgagg acaatgactt ggaagaactg gggcacagcc
4621 agtcccagac actggtggag gctgcagtga cttttttttgg ctcaagatcc acaagcatta
4681 gagtagactg ggcaacaag tcaacaagtg gtggcgtgtg caaacgggct gccctagtca
4741 agcccagtcc cttcaacagt atgtctgatg caccacaggc cctccctact ggaagtggga
4801 acttcaaatg gaaattggag ccatctttta tcccagaagc ctttgctgct gccagggcaa
4861 gtgggctggt gtggactctt gtttaggagg ctgaggttct tgtcactcct tagccagcca
4921 ggcctttagt gtctttgtaa aaagcatgta tttatagtgt tttagatttt tctaactttt
4981 gtatcttaca gcattgtacc ccattgttaa agagccgtgt cccctcttct tataaacgcc
5041 cttctaataa acttttcacc gtaaagctcc tgagacagga gcacagtctg
```

SEQ ID NO: 154 Mouse SMAD3 amino acid sequence (NP_032565.2)

```
  1 mssilpftpp ivkrllgwkk geqngqeekw cekavkslvk klkktgqlde lekaittqnv
 61 ntkcitiprs ldgrlqvshr kglphviycr lwrwpdlhsh helramelce fafnmkkdev
121 cvnpyhyqrv etpvlppvlv prhteipaef ppldddyshsi pentnfpagi epqsnipetp
181 ppgylsedge tsdhqmnhsm dagspnlspn pmspahnnld lqpvtycepa fwcsisyyel
241 nqrvgetfha sqpsmtvdgf tdpsnserfc lgllsnvnrn aaveltrrhi grgvrlyyig
301 gevfaeclsd saifvqspnc nqrygwhpat vckippgcnl kifnnqefaa llaqsvnqgf
361 eavyqltrmc tirmsfvkgw gaeyrrqtvt stpcwielhl ngplqwldkv ltqmgspsir
421 cssvs
```

TABLE 1-continued

SEQ ID NO: 155 Human SMAD4 cDNA sequence (NM_005359.5; CDS: 539-2197)

```
   1 atgctcagtg gcttctcgac aagttggcag caacaacacg gccctggtcg tcgtcgccgc
  61 tgcggtaacg gagcggtttg ggtggcggag cctgcgttcg cgccttcccg ctctcctcgg
 121 gaggcccttc ctgctctccc ctaggctccg cggccgccca gggggtggga gcgggtgagg
 181 ggagccaggc gcccagcgag agaggccccc cgccgcaggg cggcccggga gctcgaggcg
 241 gtccggcccg cgcgggcagc ggcgcggcgc tgaggagggg cggcctggcc gggacgcctc
 301 ggggcggggg ccgaggagct ctccgggccg ccggggaaag ctacgggccc ggtgcgtccg
 361 cggaccagca gcgcgggaga gcggactccc ctcgccaccg cccgagccca ggttatcctg
 421 aatacatgtc taacaatttt ccttgcaacg ttagctgttg tttttcactg tttccaaagg
 481 atcaaaattg cttcagaaat tggagacata tttgatttaa aaggaaaaac ttgaacaaat
 541 ggacaatatg tctattacga atacaccaac aagtaatgat gcctgtctga gcattgtgca
 601 tagtttgatg tgccatagac aaggtggaga gagtgaaaca tttgcaaaaa gagcaattga
 661 aagtttggta aagaagctga aggagaaaaa agatgaattg gattctttaa taacagctat
 721 aactacaaat ggagctcatc ctagtaaatg tgttaccata cagagaacat tggatgggag
 781 gcttcaggtg gctggtcgga aaggatttcc tcatgtgatc tatgcccgtc tctggaggtg
 841 gcctgatctt cacaaaaatg aactaaaaca tgttaaatat tgtcagtatg cgtttgactt
 901 aaaatgtgat agtgtctgtg tgaatccata tcactacgaa cgagttgtat cacctggaat
 961 tgatctctca ggattaacac tgcagagtaa tgctccatca agtatgatgg tgaaggatga
1021 atatgtgcat gactttgagg gacagccatc gttgtccact gaaggacatt caattcaaac
1081 catccagcat ccaccaagta atcgtgcatc gacagagaca tacagcaccc cagctctgtt
1141 agccccatct gagtctaatg ctaccagcac tgccaacttt cccaacattc ctgtggcttc
1201 cacaagtcag cctgccagta tactgggggg cagccatagt gaaggactgt tgcagatagc
1261 atcagggcct cagccaggac agcagcagaa tggatttact ggtcagccag ctacttacca
1321 tcataacagc actaccacct ggactggaag taggactgca ccatacacac ctaatttgcc
1381 tcaccaccaa aacggccatc ttcagcacca cccgcctatg ccgccccatc ccggacatta
1441 ctggcctgtt cacaatgagc ttgcattcca gcctcccatt tccaatcatc ctgctcctga
1501 gtattggtgt tccattgctt actttgaaat ggatgttcag gtaggagaga catttaaggt
1561 tccttcaagc tgccctattg ttactgttga tggatacgtg gacccttctg gaggagatcg
1621 cttttgtttg ggtcaactct ccaatgtcca caggacagaa gccattgaga gagcaaggtt
1681 gcacataggc aaaggtgtgc agttggaatg taaaggtgaa ggtgatgttt gggtcaggtg
1741 ccttagtgac cacgcggtct ttgtacagag ttactactta gacagagaag ctgggcgtgc
1801 acctggagat gctgttcata agatctaccc aagtgcatat ataaaggtct ttgatttgcg
1861 tcagtgtcat cgacagatgc agcagcaggc ggctactgca caagctgcag cagctgccca
1921 ggcagcagcc gtggcaggaa acatccctgg cccaggatca gtaggtggaa tagctccagc
1981 tatcagtctg tcagctgctg ctggaattgg tgttgatgac cttcgtcgct tatgcatact
2041 caggatgagt tttgtgaaag gctggggacc ggattaccca agacagagca tcaaagaaac
2101 accttgctgg attgaaattc acttacaccg ggccctccag ctcctagacg aagtacttca
2161 taccatgccg attgcagacc cacaaccttt agactgaggt cttttaccgt tggggccctt
2221 aaccttatca ggatggtgga ctacaaaata caatcctgtt tataatctga agatatattt
2281 cacttttgtt ctgctttatc ttttcataaa gggttgaaaa tgtgtttgct gccttgctcc
2341 tagcagacag aaactggatt aaaacaattt tttttttcct cttcagaact tgtcaggcat
2401 ggctcagagc ttgaagatta ggagaaacac attcttatta attcttcacc tgttatgtat
2461 gaaggaatca ttccagtgct agaaaattta gccctttaaa acgtcttaga gccttttatc
2521 tgcagaacat cgatatgtat atcattctac agaataatcc agtattgctg attttaaagg
2581 cagagaagtt ctcaaagtta attcacctat gttattttgt gtacaagttg ttattgttga
2641 acatacttca aaaataatgt gccatgtggg tgagttaatt ttaccaagag taactttact
2701 ctgtgtttaa aaagtaagtt aataatgtat tgtaatcttt catccaaaat atttttgca
2761 agttatatta gtgaagatgg tttcaattca gattgtcttg caacttcagt tttatttttg
2821 ccaaggcaaa aaactcttaa tctgtgtgta tattgagaat cccttaaaat taccagacaa
2881 aaaaatttaa aattacgttt gttattccta gtggatgact gttgatgaag tatacttttc
2941 ccctgttaaa cagtagttgt attcttctgt atttctaggc acaaggttgg ttgctaagaa
3001 gcctataaga ggaatttctt ttccttcatt catagggaaa ggttttgtat tttttaaaac
3061 actaaaagca gcgtcactct acctaatgtc tcactgttct gcaaaggtgg caatgcttaa
3121 actaaataat gaataaactg aatattttgg aaactgctaa attctatgtt aaatactgtg
3181 cagaataatg gaaacattac agttcataat aggtagtttg gatattttg tacttgattt
3241 gatgtgactt tttttggtat aatgtttaaa tcatgtatgt tatgatattg tttaaaattc
3301 agtttttgta tcttggggca agactgcaaa ctttttata tcttttggtt attctaagcc
3361 ctttgccatc aatgatcata tcaattggca gtgactttgt atagagaatt taagtagaaa
3421 agttgcagat gtattgactg taccacagac acaatatgta tgctttttac ctagctggta
3481 gcataaataa aactgaatct caacatacaa agttgaattc taggtttgat ttttaagatt
3541 ttttttttct tttgcacttt tgagtccaat ctcagtgatg aggtaccttc tactaaatga
3601 caggcaacag ccagttctat tgggcagctt tgtttttttc cctcacactc taccgggact
3661 tccccatgga cattgtgtat catgtgtaga gttggttttt ttttttttta atttttattt
3721 tactatagca gaaatagacc tgattatcta caagatgata aatagattgt ctacaggata
3781 aatagtatga aataaaatca aggattatct ttcagatgtg tttacttttg cctggagaac
3841 ttttagctat agaaacactt gtgtgatgat agtcctcctt atatcacctg gaatgaacac
3901 agcttctact gccttgctca gaaggtcttt taaatagacc atcctagaaa ccactgagtt
3961 tgcttatttc tgtgatttaa acatagatct tgatccaagc tacatgactt ttgtctttaa
4021 ataacttatc taccacctca tttgtactct tgattactta caaattcttt cagtaaacac
4081 ctaattttct tctgtaaaag tttggtgatt taagttttat tggcagtttt ataaaaagac
4141 atcttctcta gaaattgcta actttaggtc cattttactg tgaatgagga ataggagtga
4201 gttttagaat aacagatttt taaaaatcca gatgatttga ttaaaacctt aatcatacat
4261 tgacataatt cattgcttct tttttttgag atatggagtc ttgctgtgtt gcccaggcag
4321 gagtgcagtg gtatgatctc agctcactgc aacctctgcc tcccgggttc aactgattct
4381 cctgcctcag cctccctggt agctaggatt acaggtgccc gccaccatgc ctggctaact
4441 tttgtagttt tagtagagac ggggttttgc ctgttggcca ggctggtctt gaactcctga
4501 cctcaagtga tccatccacc ttggcctccc aaagtgctgg gattacgggc gtgagccact
4561 gtccctggcc tcattgttcc cttttctact ttaaggaaag ttttcatgtt taatcatctg
4621 gggaaagtat gtgaaaaata tttgttaaga agtatctctt tggagccaag ccacctgtct
```

TABLE 1-continued

```
4681 tggtttcttt ctactaagag ccataaagta tagaaatact tctagttgtt aagtgcttat
4741 atttgtacct agatttagtc acacgctttt gagaaaacat ctagtatgtt atgatcagct
4801 attcctgaga gcttggttgt taatctatat ttctatttct tagtggtagt catctttgat
4861 gaataagact aaagattctc acaggtttaa aattttatgt ctactttaag ggtaaaatta
4921 tgaggttatg gttctgggtg ggttttctct agctaattca tatctcaaag agtctcaaaa
4981 tgttgaattt cagtgcaagc tgaatgagag atgagccatg tacacccacc gtaagacctc
5041 attccatgtt tgtccagtgc ctttcagtgc attatcaaag ggaatccttc atggtgttgc
5101 ctttattttc cggggagtag atcgtgggat atagtctatc tcatttttaa tagtttaccg
5161 cccctggtat acaaagataa tgacaataaa tcactgccat ataaccttgc tttttccaga
5221 aacatggctg ttttgtattg ctgtaaccac taaataggtt gcctatacca ttcctcctgt
5281 gaacagtgca gatttacagg ttgcatggtc tggcttaagg agagccatac ttgagacatg
5341 tgagtaaact gaactcatat tagctgtgct gcatttcaga cttaaaatcc atttttgtgg
5401 ggcagggtgt ggtgtgtaaa ggggggtgtt tgtaatacaa gttgaaggca aaataaaatg
5461 tcctgtctcc cagatgatat acatcttatt atttttaaag tttattgcta attgtaggaa
5521 ggtgagttgc aggtatcttt gactatggtc atctggggaa ggaaaatttt acattttact
5581 attaatgctc cttaagtgtc tatggaggtt aaagaataaa atggtaaatg tttctgtgcc
5641 tggtttgatg gtaactggtt aatagttact caccatttta tgcagagtca cattagttca
5701 caccctttct gagagccttt tgggagaagc agttttattc tctgagtgga acagagttct
5761 ttttgttgat aatttctagt ttgctccctt cgttattgcc aactttactg gcattttatt
5821 taatgatagc agattgggaa aatggcaaat ttaggttacg gaggtaaatg agtatatgaa
5881 agcaattacc tctaaagcca gttaacaatt attttgtagg tggggtacac tcagcttaaa
5941 gtaatgcatt tttttttccc gtaaaggcag aatccatctt gttgcagata gctatctaaa
6001 taatctcata tcctcttttg caaagactac agagaatagg ctatgacaat cttgttcaag
6061 cctttccatt tttttccctg ataactaagt aatttctttg aacataccaa gaagtatgta
6121 aaaagtccat ggccttattc atccacaaag tggcatccta ggcccagcct tatccctagc
6181 agttgtccca gtgctgctag gttgcttatc ttgtttatct ggaatcactg tggagtgaaa
6241 ttttccacat catccagaat tgccttattt aagaagtaaa acgttttaat ttttagcctt
6301 tttttggtgg agttatttaa tatgtatatc agaggatata ctagatggta acatttcttt
6361 ctgtgcttgg ctatctttgt ggacttcagg ggcttctaaa acagacagga ctgtgttgcc
6421 tttactaaat ggtctgagac agctatggtt ttgaattttt agtttttttt ttttaaccca
6481 cttcccctcc tggtctcttc cctctctgat aattaccatt catatgtgag tgttagtgtg
6541 cctcctttta gcatttcttc cttctctttc tgattcttca tttctgactg cctaggcaag
6601 gaaaccagat aaccaaactt actagaacgt tctttaaaac acaagtacaa actctgggac
6661 aggacccaag acactttcct gtgaagtgct gaaaaagacc tcattgtatt ggcatttgat
6721 atcagtttga tgtagcttag agtgcttcct gattcttgct gagtttcagg tagttgagat
6781 agagagaagt gagtcatatt catatttcc ccccttagaat aatattttga aaggtttcat
6841 tgcttccact tgaatgctgc tcttacaaaa actggggtta caagggttac taaattagca
6901 tcagtagcca gaggcaatac cgttgtctgg aggacaccag caaacaacac acaacaaagc
6961 aaaacaaacc ttgggaaact aaggccattt gttttgtttt ggtgtcccct ttgaagccct
7021 gccttctggc cttactcctg tacagatatt tttgacctat aggtgccttt atgagaattg
7081 agggtctgac atcctgcccc aaggagtagc taaagtaatt gctagtgttt tcagggattt
7141 taacatcaga ctggaatgaa tgaatgaaac tttttgtcct tttttttttct gttttttttt
7201 ttctaatgta gtaaggacta aggaaaacct ttggtgaaga caatcatttc tctctgttga
7261 tgtggatact tttcacaccg tttatttaaa tgctttctca ataggtccag agccagtgtt
7321 cttgttcaac ctgaaagtaa tggctctggg ttgggccaga cagttgcact ctctagtttg
7381 ccctctgcca caaatttgat gtgtgacctt tgggcaagtc atttatcttc tctgggcctt
7441 agttgcctca tctgtaaaat gagggagttg gagtagatta attattccag ctctgaaatt
7501 ctaagtgacc ttggctacct tgcagcagtt ttggatttct tccttatctt tgttctgctg
7561 tttgaggggg ctttttactt atttccatgt tattcaaagg agactaggct tgatatttta
7621 ttactgttct tttatggaca aaaggttaca tagtatgccc ttaagactta attttaacca
7681 aaggcctagc accaccttag gggctgcaat aaacacttaa cgcgcgtgcg cacgcgcgcg
7741 cgcacacaca cacacacaca cacacacaca cacaggtcag agtttaaggc tttcgagtca
7801 tgacattcta gcttttgaat tgcgtgcaca cacacacgca cgcacacact ctggtcagag
7861 tttattaagg ctttcgagtc atgacattat agcttttgag ttggtgtgtg tgacaccacc
7921 ctcctaagtg gtgtgtgctt gtaatttttt ttttcagtga aaatggattg aaaacctgtt
7981 gttaatgctt agtgatatta tgctcaaaac aaggaaattc ccttgaaccg tgtcaattaa
8041 actggtttat atgactcaag aaaacaatac cagtagatga ttattaactt tattcttggc
8101 tctttttagg tccattttga ttaagtgact tttggctgga tcattcagag ctctcttcta
8161 gcctaccctt ggatgagtac aattaatgaa attcatattt tcaaggacct gggagccttc
8221 cttggggctg ggttgagggt ggggggttgg ggagtcctgg tagaggccag ctttgtggta
8281 gctggagagg aagggatgaa accagctgct gttgcaaagg ctgcttgtca ttgatagaag
8341 gactcacggg cttggattga ttaagactaa acatggagtt ggcaaacttt cttcaagtat
8401 tgagttctgt tcaatgcatt ggacatgtga tttaagggaa aagtgtgaat gcttatagat
8461 gatgaaaacc tggtgggctg cagagcccag tttagaagaa gtgagttggg ggttggggac
8521 agatttggtg gtggtatttc ccaactgttt cctcccctaa attcagagga atgcagctat
8581 gccagaagcc agagaagagc cactcgtagc ttctgctttg gggacaactg gtcagttgaa
8641 agtcccagga gttcctttgt ggctttctgt atacttttgc ctggttaaag tctgtggcta
8701 aaaaatagtc gaacctttct tgagaactct gtaacaaagt atgtttttga ttaaaagaga
8761 aagccaacta aaaaaaaaaa aaaaaaaaa
```

SEQ ID NO: 156 Human SMAD4 amino acid sequence (NP_005350.1)

```
  1 mdnmsitntp tsndaclsiv hslmchrqgg esetfakrai eslvkklkek kdeldslita
 61 ittngahpsk cvtiqrtldg rlqvagrkgf phviyarlwr wpdlhknelk hvkycqyafd
121 lkcdsvcvnp yhyervvspg idlsgltlqs napssmmvkd eyvhdfegqp slsteghsiq
181 tiqhppsnra stetystpal lapsesnats tanfpnipva stsqpasilg gshsegllqi
241 asgpqpgqqq ngftgqpaty hhnstttwtg srtapytpnl phhqnghlqh hppmpphpgh
301 ywpvhnelaf qppisnhpap eywcsiayfe mdvqvgetfk vpsscpivtv dgyvdpsggd
361 rfclgqlsnv hrteaierar lhigkgvqle ckgegdvwvr clsdhavfvq syyldreagr
```

TABLE 1-continued

```
 421 apgdavhkiy psayikvfdl rqchrqmqqq aataqaaaaa qaaavagnip gpgsvggiap
 481 aislsaaagi gvddlrrlci lrmsfvkgwg pdyprqsike tpcwieihlh ralqlldevl
 541 htmpiadpqp ld
```

SEQ ID NO: 157 Mouse SMAD4 transcript variant 1 cDNA sequence
(NM_001364967.1; CDS: 491-1699)

```
   1 agtgtccttc cgacaagttg gcagcaacaa cacggccctg gtcgtcgtcg ccgctgcggt
  61 aacggagcgg ctcgggtggc ggagcccgtg ttcgcgtccg tccgcccgcc cgcccgccgt
 121 cctccggagg cccttcccgc gccgcgctcc gctccgcggc cgtccccggg gcgggagcgc
 181 gtgaccggag ccggcgcccg cgagcgaggc cccccgcagc ggggcggctc cggagctcca
 241 gcggcccggc cggccggcgc ggtccgcggc gcggcgggga gagggggccg cctgggccgg
 301 acgccgcggg cggggcccgg gaagcgacag cgaggcgagg cgcggtgcgg cgaggagccc
 361 aggtcatcct gctcaccaga tgtcttgaca gtttttcttg caacattggc cattggtttt
 421 cactgccttc aaaagatcaa aattactcca gaaattggag agttggattt aaaagaaaaa
 481 acttgaacaa atggacaata tgtctataac aaatacacca acaagtaacg atgcctgtct
 541 gagcattgta catagtttga tgtgtcatag acaaggtggg gaaagtgaaa cctttgcaaa
 601 aagagcaatt gagagtttgg taaagaagct gaaagagaaa aaagatgaat tggattcttt
 661 aataacagct ataactacaa atggagctca tcctagcaag tgtgtcacca tacagagaac
 721 attggatgga cgacttcagg tggctggtcg gaaaggattt cctcatgtga tctatgcccg
 781 tctgtggagg tggcctgatc tacacaagaa tgaactaaag catgttaaat attgtcagta
 841 tgcgtttgac ttaaaatgtg acagtgtctg tgtgaatcca tatcactatg agcgggttgt
 901 ctcacctgga attgatctct caggattaac actgcagagt aatgctccaa gtatgttagt
 961 gaaggatgag tacgttcacg actttgaagg acagccgtcc ttacccactg aaggacattc
1021 gattcaaacc atccaacacc cgccaagtaa tcgcgcatca acggagacgt acagcgcccc
1081 ggctctgtta gccccggcag agtctaacgc caccagcacc accaacttcc ccaacattcc
1141 tgtggcttcc acaaggccag ttcacaatga gcttgcattc cagcctccca tttccaatca
1201 tcctgctcct gagtactggt gctccattgc ttactttgaa atggacgttc aggtaggaga
1261 gacgtttaag gtcccttcaa gctgccctgt tgtgactgtg gatggctatg tggatccttc
1321 gggaggagat cgctttttgct tgggtcaact ctccaatgtc cacaggacag aagcgattga
1381 gagagcgagg ttgcacatag gcaaaggagt gcagttggaa tgtaaaggtg aaggtgacgt
1441 ttgggtcagg tgccttagtg accacgcggt ctttgtacag agttactacc tggacagaga
1501 agctggccga gcacctggcg acgctgttca taagatctac ccaagcgcgt atataaaggt
1561 cagtgtttat atgtctttga tctgcggcag tgtcaccggc agatgcagca acaggcggcc
1621 actgcgcaag ctgcagctgc tgctcaggcg gcggccgtgg cagggaacat ccctggccct
1681 gggtccgtgg gtggaatagc tccagccatc agtctgtctg ctgctgctgg catcggtgtg
1741 gatgacctcc ggcgattgtg cattctcagg atgagctttg tgaagggctg gggcccagac
1801 taccccaggc agagcatcaa ggaaaccccg tgctggattg agattcacct tcaccgagct
1861 ctgcagctct tggatgaagt cctgcacacc atgcccattg cggaccccaca gcctttagac
1921 tgagatctca caccacggac gccctaacca tttccaggat ggtggactat gaaatatact
1981 cgtgtttata atctgaagat ctattgcatt ttgttctgct ctgtcttttc ctaaagggtt
2041 gagagatgtg tttgctgcct tgctcttagc agacagaaac tgaattaaaa cttcttttct
2101 attttagaac tttcaggtgt ggctcagtgc ttgaagatca gaaagatgca gttcttgctg
2161 agtcttccct gctggttctg tatggaggag tcggccagtg ctgggcgctc agccctttag
2221 tgtgtgcgag cgccttgcat gccgaggaga gtcagagctg ctgattgtaa ggctgagaag
2281 ttctcacagt taagccacct gccccttagt gggcgagtta ttaaacgcac tgtgctcacg
2341 tggcgctggg ccagccagct ctaccaagag caactttact ctcctttaaa aacctttttag
2401 caacctttga ttcacaatgg tttttgcaag ttaaacagtg aaggtgaatt aaattcatac
2461 tgtcttgcag acttcagggt ttcttcccca agacaaaaca ctaatctgtg tgcatattga
2521 caattcctta caattatcag tcaaagaaat gccatttaaa attacaattt ttttaatccc
2581 taatggatga ccactatcaa gatgtatact ttgccctgtt aaacagtaaa tgaattcttc
2641 tatatttcta ggcacaaggt tagttattta aaaaaaaaaa aaaaagccta ggggagggat
2701 ttttccctta attcctaggg agaaggtttt gtataaaaca ctaaaagcag tgtcactctg
2761 cctgctgctt cactgttctg caaggtggca gtacttcaac tgaaataatg aatattttgg
2821 aaactgctaa attctatgtt aaatactgtg cagaataatg gaaacagtgc agttggtaac
2881 aggtggtttg gatattttttg tacttgattt gatgtgtgac ttcttttcat atactgttaa
2941 aatcatgtat gttttgacat tgtttaaaat tcagtttttg tatcttaggg caagactgca
3001 gactttttta taccttttgg ttataagccc tgtgtttgcc atccttgatc acttggcggt
3061 gactttgtag agattgaagt ggaggagtta agacacattg actgtaccac agacacacat
3121 gtatactttc tacctagtta ctagcgtaaa taaaactgag tcactatacg aagtggaatt
3181 ctagatttgg tttttaaaat gctttccttt tgcacttttg agtccagtct cagtggcaag
3241 acaccttctg ctaaatgaca ggtggcagcc agttgtacca tgcagcgctg gttccctccc
3301 actctaccag gactttccca tggacactgt gcatcatgtg tagttggtta tttttttgagt
3361 ttttattttta ctgtagcaaa aaaaaaaaaa aaaacttgga taaatagtgt gaataaaatc
3421 aagaccatgg agatgttttt accctgagag ttttctgtga gttttaaatt gcagtaggca
3481 tttgagctct ggaaaccccg tgcatagcag ttctctttgt gccaacagaa atgaccacgt
3541 cctgcagcct gctgcggaag gttccagagg ctctgagaaa ccagagtgct gcagtgactg
3601 gggtccatct cagcccagcg cacacagcgt gcgttgtaaa agctgcctct gtgtcttgtc
3661 ttctgtactt agggatgctt tgtctcgggc ctaatcttat ctgtagaagt ttggtgattt
3721 ttttttttta aatgttgtat tgacagaatt ataaaaagat accttctcta gaaatgcttg
3781 tcttcagatc cgtttcacga tggccgggga acaggagtga gaagagagag taagctgtag
3841 tgtaacgggt ttttaagacc cagctcatct gaccaggcag tgctgtaact tgatgcttcc
3901 tgttgtacct tatggaacct ttcccatatt taatcatctt cagaaagtag gtgggaaata
3961 tttgctggga agtatctctt cagagccaag ccacttgtct tggttttctt actaagagcc
4021 atagaaatga tttctggtta ttgatgaaat ttgtaatttg cctgtcctag tctttttttcc
4081 tttcacttcg ctatctttga ataagacttt taaaaacttc cctgagttga aaaattttgg
4141 gataaaatag tttccctagt tcttagagac tgattatgat gtgggtatgg ttctgggtgg
4201 gttttttttc taagtcatag ctcaaaagtc tcccaagatt aaatttcagt gggcacccag
4261 tttgaaacca ttctactttt gtcttgtgcc tttctttgca tgattaaaga gaatctgtaa
4321 tggtattgcc tttatttgct tggaagtaga ttcttttctg ggatagagtc taccttaatc
4381 gttgtccttt accgcccctg ctgtacagat agatgctaag ccactgccgg gaacttgctt
```

TABLE 1-continued

```
4441 ttccatagac agtcttttta tactgcctga acccattgct cctgttcaca gtataagttc
4501 acagacaggg tgagccggcc gaggcgcaca cctgcagaat ccagcaacaa ccatgcttaa
4561 ctgtgtgtat ttcaaagtta gaaatccagt tttgtgggga atggtgtggt ttatattagc
4621 agctttgaag gcgaagtaac tcagaggttt tacagtctgg agaagggaag cttcctggaa
4681 tgcttgtgaa gtatctgtgg tggccaaatg tgtttgctcc tggccttgct tgtaactggc
4741 taattgtcac tcttcagatt tttaaaaatt tttaatgagc tgagaccccc ttggaaggag
4801 cttgtttgga gctggccaga gatgtttttg gtagttcctg tcttcatccg gtcttcatca
4861 ctgttttctt taatggtcag ttagtaaagt ataagttagg tcactgtcat gagtggagca
4921 ggaacaactc tcccaggtgg gggcctggaa gggactcgtt acatggagcc atctgtaact
4981 agccctttaa atcctccttt gcatgacata gagaaaaggc tgtgagactc ctgcccaggc
5041 ctttctagtt ttcccttcta gtaaccaagc aatcgcatct ctgcggtgca gtaggctgta
5101 tgtaaaaagc cgtggcctta ctcctagcag caccccttggc agggcctttt tctcagcgca
5161 gtgaggctgt gcatctggca ctcctgagga atgaaagttt tcatcatctt gccttattaa
5221 gcagtaaaac ttttgaaaaa tgagccgttt attggcagga gctatttaca caaatcagaa
5281 tattatacca tttctttttc tctctctcct gtctctgtgg acctccgggg cttctgagat
5341 agacagtact gcctagccat tcgaaatgcc caagccagct ggggttgttg ggctctcctc
5401 tcccttcctc cttcctcaca gctcctgctc ttgcgtggtt agtgagcctc tactcagtgt
5461 ttcctgtcct cgctgctcag gcgagggaag acgacaactg atagtcttag agttcacctt
5521 tctgtcgggg gcggcattgt tctgattgct gccatcgtct ccgatccttg atgagtttta
5581 tacgattgat gtggagagaa tttaattgat attcatagcc catagctgct cccctctccc
5641 tggtgttgtg gaagatttag tttccaccga attcactcaa aaagctgtcc tgttggcacc
5701 agcaaaccac acgctctttt agaaaacatc tttgcttgtt ttgtgtcctg accctgctct
5761 ctggcctcct tcctctgtag atacttctga cctataggtg cctttatgag aattgagggt
5821 ctgataccgt gccccaagga atagctgatg caatgagtga tgtttttcag ggattttagc
5881 atcaaattaa ataaatgaat gaaactttta agtccttctt ttcttttatt tttttaatgc
5941 aggaaggact gaggagacgt cgggtgacga caatcatttc tctgtgttgc tgtaaaggct
6001 ttcacacagt ttaagatgct tttctcagta gctccagagt tgatgttctt gttcaaccta
6061 aagcaggctc tggactcgcc cagaccgttg cacttgtagt ttacgacttc atgtgtcctc
6121 cctcggcaag tcattccctt ctctgggcct cagctgcctc gtctgtgaaa tgaggggttg
6181 gactattgtg ccagctctgg cttctaagtg accttgcccg ccctgcagca ggttgagatg
6241 cgctctttac ctttttctg ctgtgtgagg gggaatctta ctttttcctt tgttactcag
6301 tgagactagg cttgatcttt gagtacccgc tctcctgtgg acaagtagtt acatatgtcc
6361 ttatgactta tttttaacca aaggccgagc accaccttag gggctgccgt aagtaccata
6421 cagaacactg gggtgggggg cggggggcac cttcatttca ctgtgtcatc gtctgtgttc
6481 agagcctctg caaaggcctt catctgtcat gacattctga ctttgaagtt agtatgtgta
6541 tgattctgtc ctcctaagtg ctggcaattc ttcatctaaa ctggactgaa atcctgttgt
6601 aaatgcctgg taatattaga gggcctttct ttgggtcttt tgtagcttaa ttcctctatg
6661 ttcaaaacag gaagttcttc agaaattata tcaatatttt aattgatgct atgaaagaca
6721 gtcccagtga atgactgtcc actttatttt tgcctctttt atatccattt tgattgacaa
6781 cttttggctg gatcatgcct ttcagagagt tttcttccag cctgcttgga tgagtataat
6841 aaccgacttt gttattttta cggacctggg aacctttcta gggggtgggg tggggtgggg
6901 tggggtgggg agtcctggta gaggccacat ctgtggcagc tgtgaagaag ggatgaagcc
6961 agctgctctt gctaaggctg cttgtcattg gtagaaggac tcaccggttt gggttactta
7021 aaaggctaaa tatagagttg gcaaacttct ccaagcgggg agggtttttt ttttgttcca
7081 tgcatctaac gtgatttaaa agcatgactt cctataggtt atgaaaactg gtgtgctgca
7141 gatccagtgt ggaagaggtg actgggcgtt ggggacagct ttgatggtga cacttctagc
7201 tctgagagtc tcctactctg ggtccactct tagcttggct cttaggaaaa actggtcagc
7261 taaaggccca ccactttctt tctatagact tttgcctggt tgaagtctgt ggcttaaaaa
7321 aaatagttga atctttcttg agaactctgt aacaaagtat gtttttgatt aaaaagagaa
7381 agccaactaa a
```

SEQ ID NO: 158 Mouse SMAD4 isoform 1 amino acid sequence (NP_001351896.1)

```
  1 mdnmsitntp tsndaclsiv hslmchrqgg esetfakrai eslvkklkek kdeldslita
 61 ittngahpsk cvtiqrtldg rlqvagrkgf phviyarlwr wpdlhknelk hvkycqyafd
121 lkcdsvcvnp yhyervvspg idlsgltlqs napsmlvkde yvhdfegqps lpteghsiqt
181 iqhppsnras tetysapall apaesnatst tnfpnipvas trpvhnelaf qppisnhpap
241 eywcsiayfe mdvqvgetfk vpsscpvvtv dgyvdpsggd rfclgqlsnv hrteaierar
301 lhigkgvqle ckgegdvwvr clsdhavfvq syyldreagr apgdavhkiy psayikvsvy
361 mslicgsvtg rcsnrrplrk lqlllrrrpw qgtslalgpw ve
```

SEQ ID NO: 159 Mouse SMAD4 transcript variant 2 cDNA sequence (NM_001364968.1;CDS: 491-1858)

```
   1 agtgtccttc cgacaagttg gcagcaacaa cacggccctg gtcgtcgtcg ccgctgcggt
  61 aacggagcgg ctcgggtggc ggagcccgtg ttcgcgtccg tccgcccgcc cgcccgccgt
 121 cctccggagg cccttcccgc gccgcgctcc gctccgcggc cgtccccggg gcgggagcgc
 181 gtgaccggag ccggcgcccg cgagcgaggc cccccgcagc ggggcggctc cggagctcca
 241 gcggcccggc cggccggcgc ggtccgcggc gcggcgggga gagggggccg cctgggccgg
 301 acgccgcggg cggggcccgg gaagcgacag cgaggcgagg cgcggtgcgg cgcggagccc
 361 aggtcatcct gctcaccaga tgtcttgaca gtttttcttg caacattggc cattggtttt
 421 cactgccttc aaaagatcaa aattactcca gaaattggag agttggattt aaaagaaaaa
 481 acttgaacaa atggacaata tgtctataac aaatacacca acaagtaacg atgcctgtct
 541 gagcattgta catagtttga tgtgtcatag acaaggtggg gaaagtgaaa cctttgcaaa
 601 aagagcaatt gagagtttgg taaagaagct gaaagagaaa aaagatgaat tggattcttt
 661 aataacagct ataactacaa atggagctca tcctagcaag tgtgtcacca tacagagaac
 721 attggatgga cgacttcagg tggctggtcg gaaaggattt cctcatgtga tctatgcccg
 781 tctgtggagg tggcctgatc tacacaagaa tgaactaaag catgttaaat attgtcagta
 841 tgcgtttgac ttaaaatgtg acagtgtctg tgtgaatcca tatcactatg agagggttgt
 901 ctcacctgga attgatctct caggattaac actgcagagt aatgctccaa gtatgttagt
 961 gaaggatgag tacgttcacg actttgaagg acagccgtcc ttacccactg aaggacattc
1021 gattcaaacc atccaacacc cgccaagtaa tcgcgcatca acggagacgt acagcgcccc
```

TABLE 1-continued

| | | | | | | |
|---|---|---|---|---|---|---|
| 1081 | ggctctgtta | gccccggcag | agtctaacgc | caccagcacc | accaacttcc | ccaacattcc |
| 1141 | tgtggcttcc | acaactcctg | agtactggtg | ctccattgct | tactttgaaa | tggacgttca |
| 1201 | ggtaggagag | acgtttaagg | tcccttcaag | ctgccctgtt | gtgactgtgg | atggctatgt |
| 1261 | ggatccttcg | ggaggagatc | gcttttgctt | gggtcaactc | tccaatgtcc | acaggacaga |
| 1321 | agcgattgag | agagcgaggt | tgcacatagg | caaaggagtg | cagttggaat | gtaaaggtga |
| 1381 | aggtgacgtt | tgggtcaggt | gccttagtga | ccacgcggtc | tttgtacaga | gttactacct |
| 1441 | ggacagagaa | gctggccgag | cacctggcga | cgctgttcat | aagatctacc | caagcgcgta |
| 1501 | tataaaggtc | tttgatctgc | ggcagtgtca | ccggcagatg | cagcaacagg | cggccactgc |
| 1561 | gcaagctgca | gctgctgctc | aggcggcggc | cgtggcaggg | aacatccctg | gccctgggtc |
| 1621 | cgtgggtgga | atagctccag | ccatcagtct | gtctgctgct | gctggcatcg | gtgtggatga |
| 1681 | cctccggcga | ttgtgcattc | tcaggatgag | ctttgtgaag | ggctggggcc | cagactaccc |
| 1741 | caggcagagc | atcaaggaaa | ccccgtgctg | gattgagatt | caccttcacc | gagctctgca |
| 1801 | gctcttggat | gaagtcctgc | acaccatgcc | cattgcggac | ccacagcctt | tagactgaga |
| 1861 | tctcacacca | cggacgccct | aaccatttcc | aggatggtgg | actatgaaat | atactcgtgt |
| 1921 | ttataatctg | aagatctatt | gcattttgtt | ctgctctgtc | ttttcctaaa | gggttgagag |
| 1981 | atgtgtttgc | tgccttgctc | ttagcagaca | gaaactgaat | taaaacttct | tttctatttt |
| 2041 | agaactttca | ggtgtggctc | agtgcttgaa | gatcagaaag | atgcagttct | tgctgagtct |
| 2101 | tccctgctgg | ttctgtatgg | aggagtcggc | cagtgctggg | cgctcagccc | tttagtgtgt |
| 2161 | gcgagcgcct | tgcatgccga | ggagagtcag | agctgctgat | tgtaaggctg | agaagttctc |
| 2221 | acagttaagc | cacctgcccc | ttagtgggcg | agttattaaa | cgcactgtgc | tcacgtggcg |
| 2281 | ctgggccagc | cagctctacc | aagagcaact | ttactctcct | ttaaaaacct | tttagcaacc |
| 2341 | tttgattcac | aatggttttt | gcaagttaaa | cagtgaaggt | gaattaaatt | catactgtct |
| 2401 | tgcagacttc | agggtttctt | ccccaagaca | aaacactaat | ctgtgtgcat | attgacaatt |
| 2461 | ccttacaatt | atcagtcaaa | gaaatgccat | ttaaaattac | aattttttta | atccctaatg |
| 2521 | gatgaccact | atcaagatgt | atactttgcc | ctgttaaaca | gtaaatgaat | tcttctatat |
| 2581 | ttctaggcac | aaggttagtt | atttaaaaaa | aaaaaaaaaa | gcctagggga | gggatttttc |
| 2641 | ccttaattcc | tagggagaag | gttttgtata | aaacactaaa | agcagtgtca | ctctgcctgc |
| 2701 | tgcttcactg | ttctgcaagg | tggcagtact | tcaactgaaa | taatgaatat | tttggaaact |
| 2761 | gctaaattct | atgttaaata | ctgtgcagaa | taatggaaac | agtgcagttg | gtaacaggtg |
| 2821 | gtttggatat | ttttgtactt | gatttgatgt | gtgacttctt | ttcatatact | gttaaaatca |
| 2881 | tgtatgtttt | gacattgttt | aaaattcagt | ttttgtatct | tagggcaaga | ctgcagactt |
| 2941 | ttttatacct | tttggttata | agccctgtgt | ttgccatcct | tgatcacttg | gcggtgactt |
| 3001 | tgtagagatt | gaagtggagg | agttaagaca | cattgactgt | accacagaca | cacatgtata |
| 3061 | ctttctacct | agttactagc | gtaaataaaa | ctgagtcact | atacgaagtg | gaattctaga |
| 3121 | tttggttttt | aaaatgcttt | ccttttgcac | ttttgagtcc | agtctcagtg | gcaagacacc |
| 3181 | ttctgctaaa | tgacaggtgg | cagccagttg | taccatgcag | cgctggttcc | ctcccactct |
| 3241 | accaggactt | tcccatggac | actgtgcatc | atgtgtagtt | ggttattttt | tgagttttta |
| 3301 | ttttactgta | gcaaaaaaaa | aaaaaaaaac | ttggataaat | agtgtgaata | aaatcaagac |
| 3361 | catggagatg | tttttaccct | gagagttttc | tgtgagtttt | aaattgcagt | aggcatttga |
| 3421 | gctctggaaa | ccccgtgcat | agcagttctc | tttgtgccaa | cagaaatgac | cacgtcctgc |
| 3481 | agcctgctgc | ggaaggttcc | agaggctctg | agaaaccaga | gtgctgcagt | gactggggtc |
| 3541 | catctcagcc | cagcgcacac | agcgtgcgtt | gtaaaagctg | cctctgtgtc | ttgtcttctg |
| 3601 | tacttaggga | tgctttgtct | cgggcctaat | cttatctgta | gaagtttggt | gatttttttt |
| 3661 | ttttaaatgt | tgtattgaca | gaattataaa | aagatacctt | ctctagaaat | gcttgtcttc |
| 3721 | agatccgttt | cacgatggcc | ggggaacagg | agtgagaaga | gagagtaagc | tgtagtgtaa |
| 3781 | cgggttttta | agacccagct | catctgacca | ggcagtgctg | taacttgatg | cttcctgttg |
| 3841 | taccttatgg | aacctttccc | atatttaatc | atcttcagaa | agtaggtggg | aaatatttgc |
| 3901 | tgggaagtat | ctcttcagag | ccaagccact | tgtcttggtt | ttcttactaa | gagccataga |
| 3961 | aatgatttct | ggttattgat | gaaatttgta | atttgcctgt | cctagtcttt | tttcctttca |
| 4021 | cttcgctatc | tttgaataag | acttttaaaa | acttccctga | gttgaaaaat | tttgggataa |
| 4081 | aatagtttcc | ctagttctta | gagactgatt | atgatgtggg | tatggttctg | ggtgggtttt |
| 4141 | ttttctaagt | catagctcaa | aagtctccca | agattaaatt | tcagtgggca | cccagtttga |
| 4201 | aaccattcta | cttttgtctt | gtgcctttct | ttgcatgatt | aaagagaatc | tgtaatggta |
| 4261 | ttgcctttat | ttgcttggaa | gtagattctt | ttctgggata | gagtctacct | taatcgttgt |
| 4321 | cctttaccgc | ccctgctgta | cagatagatg | ctaagccact | gccgggaact | tgcttttcca |
| 4381 | tagacagtct | ttttatactg | cctgaaccca | ttgctcctgt | tcacagtata | agttcacaga |
| 4441 | cagggtgagc | cggccgaggc | gcacacctgc | agaatccagc | aacaaccatg | cttaactgtg |
| 4501 | tgtatttcaa | agttagaaat | ccagttttgt | ggggaatggt | gtggtttata | ttagcagctt |
| 4561 | tgaaggcgaa | gtaactcaga | ggttttacag | tctggagaag | ggaagcttcc | tggaatgctt |
| 4621 | gtgaagtatc | tgtggtggcc | aaatgtgttt | gctcctggcc | ttgcttgtaa | ctggctaatt |
| 4681 | gtcactcttc | agatttttaa | aaatttttaa | tgagctgaga | ccccccttgga | aggagcttgt |
| 4741 | ttggagctgg | ccagagatgt | ttttggtagt | tcctgtcttc | atccggtctt | catcactgtt |
| 4801 | ttctttaatg | gtcagttagt | aaagtataag | ttaggtcact | gtcatgagtg | gagcaggaac |
| 4861 | aactctccca | ggtgggggcc | tggaagggac | tcgttacatg | gagccatctg | taactagccc |
| 4921 | tttaaatcct | cctttgcatg | acatagagaa | aaggctgtga | gactcctgcc | caggcctttc |
| 4981 | tagttttccc | ttctagtaac | caagcaatcg | catctctgcg | gtgcagtagg | ctgtatgtaa |
| 5041 | aaagccgtgg | ccttactcct | agcagcaccc | ttggcagggc | ctttttctca | gcgcagtgag |
| 5101 | gctgtgcatc | tggcactcct | gaggaatgaa | agttttcatc | atcttgcctt | attaagcagt |
| 5161 | aaaacttttg | aaaaatgagc | cgtttattgg | caggagctat | ttacacaaat | cagaatatta |
| 5221 | taccatttct | ttttctctct | ctcctgtctc | tgtggacctc | cggggcttct | gagatagaca |
| 5281 | gtactgccta | gccattcgaa | atgcccaagc | cagctggggt | tgttgggctc | tcctctccct |
| 5341 | tcctccttcc | tcacagctcc | tgctcttgcg | tggttagtga | gcctctactc | agtgtttcct |
| 5401 | gtcctcgctg | ctcaggcgag | ggaagacgac | aactgatagt | cttagagttc | acctttctgt |
| 5461 | cgggggcggc | attgttctga | ttgctgccat | cgtctccgat | ccttgatgag | ttttatacga |
| 5521 | ttgatgtgga | gagaatttaa | ttgatattca | tagcccatag | ctgctcccct | ctccctggtg |
| 5581 | ttgtggaaga | tttagtttcc | accgaattca | ctcaaaaagc | tgtcctgttg | gcaccagcaa |
| 5641 | accacacgct | cttttagaaa | acatctttgc | ttgttttgtg | tcctgaccct | gctctctggc |
| 5701 | ctccttcctc | tgtagatact | tctgacctat | aggtgccttt | atgagaattg | agggtctgat |
| 5761 | accgtgcccc | aaggaatagc | tgatgcaatg | agtgatgttt | ttcagggatt | ttagcatcaa |
| 5821 | attaaataaa | tgaatgaaac | ttttaagtcc | ttcttttctt | ttattttttt | aatgcaggaa |

TABLE 1-continued 5881 ggactgagga gacgtcgggt gacgacaatc atttctctgt gttgctgtaa aggctttcac
5941 acagtttaag atgcttttct cagtagctcc agagttgatg ttcttgttca acctaaagca
6001 ggctctggac tcgcccagac cgttgcactt gtagtttacg acttcatgtg tcctccctcg
6061 gcaagtcatt cccttctctg ggcctcagct gcctcgtctg tgaaatgagg ggttggacta
6121 ttgtgccagc tctggcttct aagtgacctt gcccgccctg cagcaggttg agatgcgctc
6181 tttacctttt ttctgctgtg tgagggggaa tcttactttt tcctttgtta ctcagtgaga
6241 ctaggcttga tctttgagta cccgctctcc tgtggacaag tagttacata tgtccttatg
6301 acttattttt aaccaaaggc cgagcaccac cttaggggct gccgtaagta ccatacagaa
6361 cactggggtg gggggcgggg ggcaccttca tttcactgtg tcatcgtctg tgttcagagc
6421 ctctgcaaag gccttcatct gtcatgacat tctgactttg aagttagtat gtgtatgatt
6481 ctgtcctcct aagtgctggc aattcttcat ctaaactgga ctgaaatcct gttgtaaatg
6541 cctggtaata ttagagggcc tttctttggg tcttttgtag cttaattcct ctatgttcaa
6601 aacaggaagt tcttcagaaa ttatatcaat attttaattg atgctatgaa agacagtccc
6661 agtgaatgac tgtccacttt atttttgcct cttttatatc cattttgatt gacaactttt
6721 ggctggatca tgcctttcag agagtttttct tccagcctgc ttggatgagt ataataaccg
6781 actttgttat ttttacggac ctgggaacct ttctaggggg tggggtgggg tggggtgggg
6841 tggggagtcc tggtagaggc cacatctgtg gcagctgtga agaagggatg aagccagctg
6901 ctcttgctaa ggctgcttgt cattggtaga aggactcacc ggtttgggtt acttaaaagg
6961 ctaaatatag agttggcaaa cttctccaag cggggagggt tttttttttg ttccatgcat
7021 ctaacgtgat ttaaaagcat gacttcctat aggttatgaa aactggtgtg ctgcagatcc
7081 agtgtggaag aggtgactgg gcgttgggga cagctttgat ggtgacactt ctagctctga
7141 gagtctccta ctctgggtcc actcttagct tggctcttag gaaaaactgg tcagctaaag
7201 gcccaccact ttctttctat agacttttgc ctggttgaag tctgtggctt aaaaaaaata
7261 gttgaatctt tcttgagaac tctgtaacaa agtatgtttt tgattaaaaa gagaaagcca
7321 actaaa SEQ ID NO: 160 Mouse SMAD4 isoform 2 amino acid sequence (NP_001351897.1)
1 mdnmsitntp tsndaclsiv hslmchrqgg esetfakrai eslvkklkek kdeldslita
61 ittngahpsk cvtiqrtldg rlqvagrkgf phviyarlwr wpdlhknelk hvkycqyafd
121 lkcdsvcvnp yhyervvspg idlsgltlqs napsmlvkde yvhdfegqps lpteghsiqt
181 iqhppsnras tetysapall apaesnatst tnfpnipvas ttpeywcsia yfemdvqvge
241 tfkvpsscpv vtvdgyvdps ggdrfclgql snvhrteaie rarlhigkgv qleckgegdv
301 wvrclsdhav fvqsyyldre agrapgdavh kiypsayikv fdlrqchrqm qqqaataqaa
361 aaaqaaavag nipgpgsvgg iapaislsaa agigvddlrr lcilrmsfvk gwgpdyprqs
421 iketpcwiei hlhralqlld evlhtmpiad pqpld SEQ ID NO: 161 Mouse SMAD4 transcript variant 3 cDNA sequence (NM_008540.3; CDS: 491-2146)
1 agtgtccttc cgacaagttg gcagcaacaa cacggccctg gtcgtcgtcg ccgctgcggt
61 aacggagcgg ctcgggtggc ggagcccgtg ttcgcgtccg tccgcccgcc cgcccgccgt
121 cctccggagg cccttcccgc gccgcgctcc gctccgcggc cgtccccggg gcgggagcgc
181 gtgaccggag ccggcgcccg cgagcgaggc cccccgcagc ggggcggctc cggagctcca
241 gcggcccggc cggccggcgc ggtccgcggc gcggcgggga gagggggccg cctgggccgg
301 acgccgcggg cggggcccgg gaagcgacag cgaggcgagg cgcggtgcgg cgcggagccc
361 aggtcatcct gctcaccaga tgtcttgaca gtttttcttg caacattggc cattggtttt
421 cactgccttc aaaagatcaa aattactcca gaaattggag agttggattt aaaagaaaaa
481 acttgaacaa atggacaata tgtctataac aaatacacca acaagtaacg atgcctgtct
541 gagcattgta catagtttga tgtgtcatag acaaggtggg gaaagtgaaa cctttgcaaa
601 aagagcaatt gagagtttgg taaagaagct gaaagagaaa aaagatgaat tggattcttt
661 aataacagct ataactacaa atggagctca tcctagcaag tgtgtcacca tacagagaac
721 attggatgga cgacttcagg tggctggtcg gaaaggattt cctcatgtga tctatgcccg
781 tctgtggagg tggcctgatc tacacaagaa tgaactaaag catgttaaat attgtcagta
841 tgcgtttgac ttaaaatgtg acagtgtctg tgtgaatcca tatcactatg agagggttgt
901 ctcacctgga attgatctct caggattaac actgcagagt aatgctccaa gtatgttagt
961 gaaggatgag tacgttcacg actttgaagg acagccgtcc ttacccactg aaggacattc
1021 gattcaaacc atccaacacc cgccaagtaa tcgcgcatca acggagacgt acagcgcccc
1081 ggctctgtta gccccggcag agtctaacgc caccagcacc accaacttcc ccaacattcc
1141 tgtggcttcc acaagtcagc cggccagtat tctggcgggc agccatagtg aaggactgtt
1201 gcagatagct tcagggcctc agccaggaca gcagcagaat ggatttactg ctcagccagc
1261 tacttaccat cataacagca ctaccacctg gactggaagt aggactgcac catacacacc
1321 taatttgcct caccaccaaa acggccatct tcagcaccac ccgcctatgc cgccccatcc
1381 tggacattac tggccagttc acaatgagct tgcattccag cctcccattt ccaatcatcc
1441 tgctcctgag tactggtgct ccattgctta ctttgaaatg gacgttcagg taggagagac
1501 gtttaaggtc ccttcaagct gccctgttgt gactgtggat ggctatgtgg atccttcggg
1561 aggagatcgc ttttgcttgg gtcaactctc caatgtccac aggacagaag cgattgagag
1621 agcgaggttg cacataggca aaggagtgca gttggaatgt aaaggtgaag gtgacgtttg
1681 ggtcaggtgc cttagtgacc acgcggtctt tgtacagagt tactacctgg acagagaagc
1741 tggccgagca cctggcgacg ctgttcataa gatctaccca agcgcgtata taaaggtctt
1801 tgatctgcgg cagtgtcacc ggcagatgca gcaacaggcg gccactgcgc aagctgcagc
1861 tgctgctcag gcggcggccg tggcagggaa catccctggc cctgggtccg tgggtggaat
1921 agctccagcc atcagtctgt ctgctgctgc tggcatcggt gtggatgacc tccggcgatt
1981 gtgcattctc aggatgagct ttgtgaaggg ctggggccca gactacccca ggcagagcat
2041 caaggaaacc ccgtgctgga ttgagattca ccttcaccga gctctgcagc tcttggatga
2101 agtcctgcac accatgccca ttgcggaccc acagccttta gactgagatc tcacaccacg
2161 gacgccctaa ccatttccag gatggtggac tatgaaatat actcgtgttt ataatctgaa
2221 gatctattgc atttgttctt gctctgtctt ttcctaaagg gttgagagat gtgtttgctg
2281 ccttgctctt agcagacaga aactgaatta aaacttcttt tctattttag aactttcagg
2341 tgtggctcag tgcttgaaga tcagaaagat gcagttcttg ctgagtcttc cctgctggtt
2401 ctgtatggag gagtcggcca gtgctgggcg ctcagccctt tagtgtgtgc gagcgccttg
2461 catgccgagg agagtcagag ctgctgattg taaggctgag aagttctcac agttaagcca TABLE 1-continued

| | | | | | | |
|---|---|---|---|---|---|---|
| 2521 | cctgcccctt | agtgggcgag | ttattaaacg | cactgtgctc | acgtggcgct | gggccagcca |
| 2581 | gctctaccaa | gagcaacttt | actctccttt | aaaaaccttt | tagcaacctt | tgattcacaa |
| 2641 | tggtttttgc | aagttaaaca | gtgaaggtga | attaaattca | tactgtcttg | cagacttcag |
| 2701 | ggtttcttcc | ccaagacaaa | acactaatct | gtgtgcatat | tgacaattcc | ttacaattat |
| 2761 | cagtcaaaga | aatgccattt | aaaattacaa | tttttttaat | ccctaatgga | tgaccactat |
| 2821 | caagatgtat | actttgccct | gttaaacagt | aaatgaattc | ttctatattt | ctaggcacaa |
| 2881 | ggttagttat | ttaaaaaaaa | aaaaaaaagc | ctaggggagg | gatttttccc | ttaattccta |
| 2941 | gggagaaggt | tttgtataaa | acactaaaag | cagtgtcact | ctgcctgctg | cttcactgtt |
| 3001 | ctgcaaggtg | gcagtacttc | aactgaaata | atgaatattt | tggaaactgc | taaattctat |
| 3061 | gttaaatact | gtgcagaata | atggaaacag | tgcagttggt | aacaggtggt | ttggatattt |
| 3121 | ttgtacttga | tttgatgtgt | gacttctttt | catatactgt | taaaatcatg | tatgttttga |
| 3181 | cattgtttaa | aattcagttt | ttgtatctta | gggcaagact | gcagactttt | ttataccttt |
| 3241 | tggttataag | ccctgtgttt | gccatccttg | atcacttggc | ggtgactttg | tagagattga |
| 3301 | agtggaggag | ttaagacaca | ttgactgtac | cacagacaca | catgtatact | ttctacctag |
| 3361 | ttactagcgt | aaataaaact | gagtcactat | acgaagtgga | attctagatt | tggtttttaa |
| 3421 | aatgctttcc | ttttgcactt | ttgagtccag | tctcagtggc | aagacacctt | ctgctaaatg |
| 3481 | acaggtggca | gccagttgta | ccatgcagcg | ctggttccct | cccactctac | caggactttc |
| 3541 | ccatggacac | tgtgcatcat | gtgtagttgg | ttattttttg | agtttttatt | ttactgtagc |
| 3601 | aaaaaaaaaa | aaaaaaactt | ggataaatag | tgtgaataaa | atcaagacca | tggagatgtt |
| 3661 | tttaccctga | gagttttctg | tgagttttaa | attgcagtag | gcatttgagc | tctggaaacc |
| 3721 | ccgtgcatag | cagttctctt | tgtgccaaca | gaaatgacca | cgtcctgcag | cctgctgcgg |
| 3781 | aaggttccag | aggctctgag | aaaccagagt | gctgcagtga | ctggggtcca | tctcagccca |
| 3841 | gcgcacacag | cgtgcgttgt | aaaagctgcc | tctgtgtctt | gtcttctgta | cttagggatg |
| 3901 | ctttgtctcg | ggcctaatct | tatctgtaga | agtttggtga | tttttttttt | ttaaatgttg |
| 3961 | tattgacaga | attataaaaa | gataccttct | ctagaaatgc | ttgtcttcag | atccgtttca |
| 4021 | cgatggccgg | ggaacaggag | tgagaagaga | gagtaagctg | tagtgtaacg | ggtttttaag |
| 4081 | acccagctca | tctgaccagg | cagtgctgta | acttgatgct | tcctgttgta | ccttatggaa |
| 4141 | cctttcccat | atttaatcat | cttcagaaag | taggtgggaa | atatttgctg | ggaagtatct |
| 4201 | cttcagagcc | aagccacttg | tcttggtttt | cttactaaga | gccatagaaa | tgatttctgg |
| 4261 | ttattgatga | aatttgtaat | ttgcctgtcc | tagtcttttt | tcctttcact | tcgctatctt |
| 4321 | tgaataagac | ttttaaaaac | ttccctgagt | tgaaaaattt | tgggataaaa | tagtttccct |
| 4381 | agttcttaga | gactgattat | gatgtgggta | tggttctggg | tgggtttttt | ttctaagtca |
| 4441 | tagctcaaaa | gtctcccaag | attaaatttc | agtgggcacc | cagtttgaaa | ccattctact |
| 4501 | tttgtcttgt | gcctttcttt | gcatgattaa | agagaatctg | taatggtatt | gcctttattt |
| 4561 | gcttggaagt | agattctttt | ctgggataga | gtctacctta | atcgttgtcc | tttaccgccc |
| 4621 | ctgctgtaca | gatagatgct | aagccactgc | cgggaacttg | cttttccata | gacagtcttt |
| 4681 | ttatactgcc | tgaacccatt | gctcctgttc | acagtataag | ttcacagaca | gggtgagccg |
| 4741 | gccgaggcgc | acacctgcag | aatccagcaa | caaccatgct | taactgtgtg | tatttcaaag |
| 4801 | ttagaaatcc | agttttgtgg | ggaatggtgt | ggtttatatt | agcagctttg | aaggcgaagt |
| 4861 | aactcagagg | ttttacagtc | tggagaaggg | aagcttcctg | gaatgcttgt | gaagtatctg |
| 4921 | tggtggccaa | atgtgtttgc | tcctggcctt | gcttgtaact | ggctaattgt | cactcttcag |
| 4981 | atttttaaaa | atttttaatg | agctgagacc | cccttggaag | gagcttgttt | ggagctggcc |
| 5041 | agagatgttt | ttggtagttc | ctgtcttcat | ccggtcttca | tcactgtttt | ctttaatggt |
| 5101 | cagttagtaa | agtataagtt | aggtcactgt | catgagtgga | gcaggaacaa | ctctcccagg |
| 5161 | tgggggcctg | gaagggactc | gttacatgga | gccatctgta | actagccctt | taaatcctcc |
| 5221 | tttgcatgac | atagagaaaa | ggctgtgaga | ctcctgccca | ggcctttcta | gttttccctt |
| 5281 | ctagtaacca | agcaatcgca | tctctgcggt | gcagtaggct | gtatgtaaaa | agccgtggcc |
| 5341 | ttactcctag | cagcaccctt | ggcagggcct | ttttctcagc | gcagtgaggc | tgtgcatctg |
| 5401 | gcactcctga | ggaatgaaag | ttttcatcat | cttgccttat | taagcagtaa | aacttttgaa |
| 5461 | aaatgagccg | tttattggca | ggagctattt | acacaaatca | gaatattata | ccatttcttt |
| 5521 | ttctctctct | cctgtctctg | tggacctccg | gggcttctga | gatagacagt | actgcctagc |
| 5581 | cattcgaaat | gcccaagcca | gctggggttg | ttgggctctc | ctctcccttc | ctccttcctc |
| 5641 | acagctcctg | ctcttgcgtg | gttagtgagc | ctctactcag | tgtttcctgt | cctcgctgct |
| 5701 | caggcgaggg | aagacgacaa | ctgatagtct | tagagttcac | ctttctgtcg | gggcggcat |
| 5761 | tgttctgatt | gctgccatcg | tctccgatcc | ttgatgagtt | ttatacgatt | gatgtggaga |
| 5821 | gaatttaatt | gatattcata | gcccatagct | gctcccctct | ccctggtgtt | gtggaagatt |
| 5881 | tagtttccac | cgaattcact | caaaaagctg | tcctgttggc | accagcaaac | cacacgctct |
| 5941 | tttagaaaac | atctttgctt | gttttgtgtc | ctgaccctgc | tctctggcct | ccttcctctg |
| 6001 | tagatacttc | tgacctatag | gtgcctttat | gagaattgag | ggtctgatac | cgtgccccaa |
| 6061 | ggaatagctg | atgcaatgag | tgatgttttt | cagggatttt | agcatcaaat | taaataaatg |
| 6121 | aatgaaactt | ttaagtcctt | cttttctttt | atttttttaa | tgcaggaagg | actgaggaga |
| 6181 | cgtcgggtga | cgacaatcat | ttctctgtgt | tgctgtaaag | gctttcacac | agtttaagat |
| 6241 | gcttttctca | gtagctccag | agttgatgtt | cttgttcaac | ctaaagcagg | ctctggactc |
| 6301 | gcccagaccg | ttgcacttgt | agtttacgac | ttcatgtgtc | ctccctcggc | aagtcattcc |
| 6361 | cttctctggg | cctcagctgc | ctcgtctgtg | aaatgagggg | ttggactatt | gtgccagctc |
| 6421 | tggcttctaa | gtgaccttgc | ccgccctgca | gcaggttgag | atgcgctctt | tacctttttt |
| 6481 | ctgctgtgtg | agggggaatc | ttactttttc | ctttgttact | cagtgagact | aggcttgatc |
| 6541 | tttgagtacc | cgctctcctg | tggacaagta | gttacatatg | tccttatgac | ttatttttaa |
| 6601 | ccaaaggccg | agcaccacct | taggggctgc | cgtaagtacc | atacagaaca | ctggggtggg |
| 6661 | gggcgggggg | caccttcatt | tcactgtgtc | atcgtctgtg | ttcagagcct | ctgcaaaggc |
| 6721 | cttcatctgt | catgacattc | tgactttgaa | gttagtatgt | gtatgattct | gtcctcctaa |
| 6781 | gtgctggcaa | ttcttcatct | aaactggact | gaaatcctgt | tgtaaatgcc | tggtaatatt |
| 6841 | agagggcctt | tctttgggtc | ttttgtagct | taattcctct | atgttcaaaa | caggaagttc |
| 6901 | ttcagaaatt | atatcaatat | tttaattgat | gctatgaaag | acagtcccag | tgaatgactg |
| 6961 | tccactttat | ttttgcctct | tttatatcca | ttttgattga | caacttttgg | ctggatcatg |
| 7021 | cctttcagag | agtttcttc | cagcctgctt | ggatgagtat | aataaccgac | tttgttattt |
| 7081 | ttacggacct | gggaaccttt | ctagggggtg | gggtggggtg | gggtggggtg | gggagtcctg |
| 7141 | gtagaggcca | catctgtggc | agctgtgaag | aagggatgaa | gccagctgct | cttgctaagg |
| 7201 | ctgcttgtca | ttggtagaag | gactcaccgg | tttgggttac | ttaaaaggct | aaatatagag |
| 7261 | ttggcaaact | tctccaagcg | gggagggttt | tttttttgtt | ccatgcatct | aacgtgattt |

TABLE 1-continued

```
7321 aaaagcatga cttcctatag gttatgaaaa ctggtgtgct gcagatccag tgtggaagag
7381 gtgactgggc gttggggaca gctttgatgg tgacacttct agctctgaga gtctcctact
7441 ctgggtccac tcttagcttg gctcttagga aaaactggtc agctaaaggc ccaccacttt
7501 ctttctatag acttttgcct ggttgaagtc tgtggcttaa aaaaaatagt tgaatctttc
7561 ttgagaactc tgtaacaaag tatgtttttg attaaaaaga gaaagccaac taaa
```

SEQ ID NO: 162 Mouse SMAD4 isoform 3 amino acid sequence (NP_032566.2)

```
  1 mdnmsitntp tsndaclsiv hslmchrqgg esetfakrai eslvkklkek kdeldslita
 61 ittngahpsk cvtiqrtldg rlqvagrkgf phviyarlwr wpdlhknelk hvkycqyafd
121 lkcdsvcvnp yhyervvspg idlsgltlqs napsmlvkde yvhdfegqps lpteghsiqt
181 iqhppsnras tetysapall apaesnatst tnfpnipvas tsqpasilag shsegllqia
241 sgpqpgqqqn gftaqpatyh hnstttwtgs rtapytpnlp hhqnghlqhh ppmpphpghy
301 wpvhnelafq ppisnhpape ywcsiayfem dvqvgetfkv psscpvvtvd gyvdpsggdr
361 fclgqlsnvh rteaierarl higkgvqlec kgegdvwvrc lsdhavfvqs yyldreagra
421 pgdavhkiyp sayikvfdlr qchrqmqqqa ataqaaaaaq aaavagnipg pgsvggiapa
481 islsaaagig vddlrrlcil rmsfvkgwgp dyprqsiket pcwieihlhr alqlldevlh
541 tmpiadpqpl d
```

SEQ ID NO: 163 Human SMAD5 transcript variant 1 cDNA sequence (NM_005903.7; CDS: 363-1760)

```
   1 atccgggtcc tgggcgagcg ggcgccgtgc gcgtgtcccg cggccgagct gctaataaag
  61 ttgcagcgag gagaagcgca gcgacggcgt cgggagagcg cgcctagccg gctcgcgaaa
 121 aggaagctgt tgaagttatt gaagtacctg ttgctatatt ctaagaaatt aaaatgtcca
 181 gaaatctgcc tctgacttga cccaatgaaa gaagcatatg gcacttgtga agataaatgt
 241 tactcctccc tttttaattg gaacttctgc ttaggacctg tgtatgacgt ttcacctgtg
 301 atctgttctt tcggtagcca ctgactttga gttacaggaa ggtctccgaa gatttgtgtc
 361 aaatgacgtc aatggccagc ttgttttctt ttactagtcc agcagtaaag cgattgttgg
 421 gctggaaaca aggtgatgag gaggagaaat gggcagaaaa ggcagttgat gctttggtga
 481 agaaactaaa aaagaaaaag ggtgccatgg aggaactgga gaaagccttg agcagtccag
 541 gacagccgag taaatgtgtc actattccca gatctttaga tggacgcctg caggtttctc
 601 acagaaaagg cttaccccat gttatatatt gtcgtgtttg gcgctggccg gatttgcaga
 661 gtcatcatga gctaaagccg ttggatattt gtgaatttcc ttttggatct aagcaaaaag
 721 aagtttgtat caacccatac cactataaga gagtggagag tccagtctta cctccagtat
 781 tagtgcctcg tcataatgaa ttcaatccac aacacagcct tctggttcag tttaggaacc
 841 tgagccacaa tgaaccacac atgccacaaa atgccacgtt tccagattct ttccaccagc
 901 ccaacaacac tcctttttccc ttatctccaa acagccctta tccccttct cctgctagca
 961 gcacatatcc caactcccca gcaagttctg gaccaggaag tccatttcag ctcccagctg
1021 atacgcctcc tcctgcctat atgccacctg atgatcagat gggtcaagat aattcccagc
1081 ctatggatac aagcaataat atgattcctc agattatgcc cagtatatcc agcagggatg
1141 ttcagcctgt tgcctatgaa gagcctaaac attggtgttc aatagtctac tatgaattaa
1201 acaatcgtgt tggagaagct tttcatgcat cttctactag tgtgttagta gatggattca
1261 cagatccttc aaataacaaa agtagattct gcttgggttt gttgtcaaat gttaatcgta
1321 attcgacaat tgaaaacact aggcgacata ttggaaaagg tgttcatctg tactatgttg
1381 gtggagaggt gtatgcggaa tgcctcagtg acagcagcat atttgtacag agtaggaact
1441 gcaactttca tcatggcttt catcccacca ctgtctgtaa gattcccagc agctgcagcc
1501 tcaaaatttt taacaatcag gagtttgctc agcttctggc tcaatctgtc aaccatgggt
1561 ttgaggcagt atatgagctc accaaaatgt gtaccattcg gatgagtttt gtcaagggtt
1621 ggggagcaga atatcaccgg caggatgtaa ccagcacccc atgttggatt gagattcatc
1681 ttcatgggcc tcttcagtgg ctggataaag tccttactca gatgggctcc cctctgaacc
1741 ccatatcttc tgtttcataa tgcagaagta ttcttttcaa ttatattgtt agtggacttg
1801 ttttaatttt agagaaactt tgagtacaga tactgtgagc ttacattgaa aacagatatt
1861 acagcttatt tttttctaca taattgtgac caatacattt gtattttgtg atgaatctac
1921 atttgtttgt attcatgttc atgtgattaa ctcttagaag tgttgtaaaa gatgcagagt
1981 aagtattatg ccccagttca gaaatttggc attgatctta aactggaaca tgcttttact
2041 ttattgccct aacaattttt tattaaattt atttgaaaat gcatcacatg atgaaaaatt
2101 atagtagctt ataagagggc atatacagtg aagagtaagt tttccctcct actctcgatc
2161 ttccagaagc tgtactttta ccagtttctt tgtcccacca acttaaaaaa aaaaagtaca
2221 attcattgtt ttgcaaaagt gtatggtagg ggcttaaaag aaactataaa gttttatttg
2281 aatgaacact atgcactgct gtaactggta gtgttcagta aaagcaaaat gatagttttc
2341 tagatgacat aaaatttaca tttaatacag ataagtgttc ttcagtgtaa tgtgacttca
2401 tgctatatat cttttgtaag acatttcctt ttttaaaaaa atttttgcaa ataactgatc
2461 tcaaagtatat gtcatttact caaaatctgt cataagcatt actttatagc tagtgacagt
2521 gcatgcacag ccttgttcaa ctatgtttgc tgcttttgga caatgttgca agaactctat
2581 ttttgacatg cattaatctt ttattttgca cttttatggg tgacagtttt tagcataacc
2641 tttgataaaa tacactcaag tgacttggac ttagatgctt atccttacgt ccttggtacc
2701 ttttttgtat taacaaacac tgcaatttat agattacatt tgtaggaagt tatgcttttt
2761 tctggttttt gttttacttt caacctaggt tataagactg ttattctata gctccaactt
2821 aaggtgcctt tttaattccc tacagtttta tgggtgttat cagtgctgga gaatcatgta
2881 gttaatccca ttgctcttac aagtgtcagc ttacttgtat cagcctccct acgcaaggac
2941 ctatgcactg gagccgtagg aggctcttca gttgggcccc aaggataagg ctactgattt
3001 gatactaaat gaatcagcag tggatgtagg gatagctgat tttaaaacac tcggctgggc
3061 acagtggctc acacctgtaa tcccagcact ttgggaggct gaggcaggca gatcatgatg
3121 tcaggagttt gagaccagcc tggccaatat ggtgaaaccc tgtctctaca aaaaatacaa
3181 aaattagctg ggcatggtgg tgcgtgcctg aagtcccagc tactcgggaa gctgaggcag
3241 aagaatcact tgaacctggg aggcggaggt tgtggtgagc cgagatcgca ccactgcact
3301 ccagcctggg cgacagagcg agactctgcc tcaaaaaaca aaacaaaaca aaacactcac
3361 ccatcaacga atatagactc ttctctcatt tatcgatgat cctctttttc catttttttaa
3421 gtacttatgt ggaagctagt ctcccaaaac acaatcttta gagagaaaag acatgaacga
3481 actccaaaat atccatttaa tcaatcatgt ttttggcttt ggataaagaa ctttgaacca
3541 gtttttttct caggagctgt caaatggaca cttaattatg acatgagaat gaagaaatta
```

TABLE 1-continued

```
3601 ttttggaaaa aaaaaatgac ctaatttacc tatcagtgaa agctttattt tctggtgcct
3661 tttgaaagta tatggagtca tatcattctt ctgtttaaaa tgttagtttg gtttgacttt
3721 ccactttgtc ctttctgctc ttgtgaagaa aaaaaaaagc attttcgagg aaagaattat
3781 gcaatttctt ttgttttctg tgtcattatt tattgctttt tcaatgtgca gccagtggat
3841 ggttttagtt ctttcagatg aactgccatt tgtgtttcag ctcacagttc tttgctgggt
3901 aaaagaaata ctttctgaca gtcacctgag ccttaaatgt aagtattaca tgacatgcat
3961 tctgtttctt ccagagttct gtctgccaca cgaaagagaa tatttgctta cttgatagaa
4021 ctttggcatt ttcatcattc ttttacttaa ccaggcttat ggcatgatct ctggaacaaa
4081 tttgtaggaa aaaattactc caattgaatg actgatgtat gtaatcaact tcattgggct
4141 gcagtaaact agtggaaatt agagagttgt tttattggtg ttttctactg tgagttaatt
4201 aaaaattgtt tttatttggg gtcattatgt cacagtcttg agttaacaag atcttacgtg
4261 attggccttt tctttgtttt ctcttaggag ttgtgtctca tgaatgacag tactaaagct
4321 attaacaact aagagtttga cagagaacta taagcctgtt gtatctccta aaagttgtca
4381 actccccacc cttggacttt aaatgaaaat tttattcagt ccagctattc ttacagtccc
4441 taaggatttt catatatcta tgtataggag ataaaatttg ctagtaagat ttttaaaaac
4501 tggctagtga aaggaaagta cctctgaaag aaaccatttt agcaaattat ggttatatgt
4561 tttaatttaa tctacagaat gttttatagt aaaattctag caccactaga ataatcacat
4621 agcatgtaca atatatttat gctggctgaa aagacagaat ctgggaataa taaaattgca
4681 accagtttgg taatgcaaac agcagaatag aatgaaatct cagtaatgaa ttaaagcaac
4741 aaaaagatat tgattggcaa aaagcaagat ataagagatt catttgctta acatttctac
4801 ataatattta tggtctggtc agtattggtc tggtcagtat tgcctggctg acgtgaaatg
4861 taaactagta ggcgtgttat tgatctgcta aaactaaccc tctttttaag aggagattta
4921 aggaagacgt caatcaaaat gtcaaatatg tgtgtcagaa tataaataat ttttcacatt
4981 gtattgttgc tatataaaaa aaataataga attggttggg tttctgaggt gaaatccaga
5041 gtaagagtac tagacagttc aacaagccac atctaatggc acagatagag gatgtagcta
5101 ttttatacct ttcataacat ttgagagtaa gatatccttc aggatgtgaa gtgattatta
5161 agtactcata cctgaaatct gttgtcaaga ttagaactgg ggttcatgtt aaaaaccttc
5221 catattacct gagggtacct gtggggaaca gttccttccc ctgtgtggta gtattttgtt
5281 ggaagagaat gtttatacaa aaaatgaaat tcttccaaca gcagagaaac tctaaaaagt
5341 ttgatagtac ctatcaaagt gctgtacttc tgtgatagag aacatctgat gtaccaattt
5401 agatctattt ctttatactt tttctaatca attgcttaat agtactttgg atgattatca
5461 cctttgccac ttaaaatata taaatatcct ttttacttca tgaggaagga agaatttttt
5521 gataattact gagttcagcc ttttgtgatg acttatattt tggacttaca ttttaacttt
5581 aaagaatgtc agatcccttc tttgtcttac tagttaaatc ctcacctaat ctcttgggta
5641 tgaatataaa tgtgtgtcat cgttatattg ttcagctaga tgagcaagta tcttagggta
5701 gtaggtagcc tggtggtttt agaagtgttt ggtgattttt atggagagag ttttcctaag
5761 tggtggttta taggtggtat cagatattat tagggcagct ttttggggag taatctcagg
5821 tctcccagag cagcagcatt tttctcattg atataagtaa gattcttagg agcttttctt
5881 atcacacaag atgcctgaat cgaatgtgag aattgaaggc atttcttctg cataaacaaa
5941 gaattctacc tgctggacag aaacctggaa agttctttgg aattcgctga attacagttt
6001 agtatgtcct gattacagag tgacaatatt tatcaagcct ttgttatatt ggattatctt
6061 ctctcttaaa atacaactgt attataattg aaatgacagc ccaaaattgg atggtttacc
6121 aaaaccaatg aaagggattt cacacatcaa tttttatttc tgttttgaag agcacatgct
6181 atataataat tgctagtagc aactgcagta aaacaggtga taagttattt tctctgaaaa
6241 gatccagtcc tagagcagga ttcttcgatc attcatggca gagtgaaaaa ggtttgtatg
6301 gttcttgtcc aaataactca gttcttaaaa ttcttaaaat gatcgtaaac cattatcctt
6361 taaaggttta tttgaagatg ctgttaaagt acagaatttt gtgtacaggt agatttttcc
6421 gtccctcatt aatagtgcct tcttaattaa tacagactgg tgttagctat aacaaaactc
6481 cagtaaggcc aaagaatccc aagttctttg tggaaaaaaa aaaaaaatct tttagggtca
6541 gattttccct tctaatatca ttgaagatga tgttgcattg atttattcat aaagtatttt
6601 aactatagga actctagaag ataatggtta ggcaagtgat ttttttttta aatatggttg
6661 gcgtaagttg tattttgaaa ttcacttatt ttaaaatcga agaggattgt aatcatggaa
6721 atagaatgtt tgtatctacc tgcccacatt ttcttaaaaa gatatttcat atacagataa
6781 tgaagaccaa gctagtggct gcactgtagg tctgctgctt atttgtattt gttgtgcttc
6841 tgtttatgtt gtagaagctg aaattctagc aacatgcttc aattctgtta ttttgatact
6901 tatgaaaatg tattaggttt tactatattg tgcttttgaa agccataact cttaagaact
6961 ttgtttttgc atattgtttg ctaattcttt actttaataa acctcaaaac ctg
```

SEQ ID NO: 164 Human SMAD5 transcript variant 2 cDNA sequence
(NM_001001419.3; CDS: 447-1844)

```
   1 atccgggtcc tgggcgagcg ggcgccgtgc gcgtgtcccg cggccgagct gctaataaag
  61 ttgcagcgag gagaagcgca gcgacggcgt cgggagagcg cgcctagccg gctcgcgaaa
 121 aggaagctgt tgaagttatt gaagtacctg ttgctatatt ctaagaaatt aaaatgtcca
 181 gaaatctgcc tctaaatggg atctcactat gttgctcaga ctggacgtga ttgaactcct
 241 gggctcaagt gagtctcccg aataactggg attacaggac ttgacccaat gaaagaagca
 301 tatggcactt gtgaagataa atgttactcc tccctttta attggaactt ctgcttagga
 361 cctgtgtatg acgtttcacc tgtgatctgt tctttcggta gccactgact ttgagttaca
 421 ggaaggtctc cgaagatttg tgtcaaatga cgtcaatggc cagcttgttt tcttttacta
 481 gtccagcagt aaagcgattg ttgggctgga aacaaggtga tgaggaggag aaatgggcag
 541 aaaaggcagt tgatgctttg gtgaagaaac taaaaaagaa aaagggtgcc atggaggaac
 601 tggagaaagc cttgagcagt ccaggacagc cgagtaaatg tgtcactatt cccagatctt
 661 tagatggacg cctgcaggtt tctcacagaa aaggcttacc ccatgttata tattgtcgtg
 721 tttggcgctg gccggatttg cagagtcatc atgagctaaa gccgttggat atttgtgaat
 781 ttcctttggg atctaagcaa aaagaagttt gtatcaaccc ataccactat aagagagtgg
 841 agagtccagt cttacctcca gtattagtgc ctcgtcataa tgaattcaat ccacaacaca
 901 gccttctggt tcagtttagg aacctgagcc acaatgaacc acacatgcca caaaatgcca
 961 cgtttccaga ttctttccac cagcccaaca acactccttt tcccttatct ccaaacagcc
1021 cttatccccc ttctcctgct agcagcacat atcccaactc cccagcaagt tctggaccag
1081 gaagtccatt tcagctccca gctgatacgc ctcctcctgc ctatatgcca cctgatgatc
1141 agatgggtca agataattcc cagcctatgg atacaagcaa taatatgatt cctcagatta
```

TABLE 1-continued

| | | | | | | |
|---|---|---|---|---|---|---|
| 1201 | tgcccagtat | atccagcagg | gatgttcagc | ctgttgccta | tgaagagcct | aaacattggt |
| 1261 | gttcaatagt | ctactatgaa | ttaaacaatc | gtgttggaga | agcttttcat | gcatcttcta |
| 1321 | ctagtgtgtt | agtagatgga | ttcacagatc | cttcaaataa | caaaagtaga | ttctgcttgg |
| 1381 | gtttgttgtc | aaatgttaat | cgtaattcga | caattgaaaa | cactaggcga | catattggaa |
| 1441 | aaggtgttca | tctgtactat | gttggtggag | aggtgtatgc | ggaatgcctc | agtgacagca |
| 1501 | gcatatttgt | acagagtagg | aactgcaact | ttcatcatgg | ctttcatccc | accactgtct |
| 1561 | gtaagattcc | cagcagctgc | agcctcaaaa | tttttaacaa | tcaggagttt | gctcagcttc |
| 1621 | tggctcaatc | tgtcaaccat | gggtttgagg | cagtatatga | gctcaccaaa | atgtgtacca |
| 1681 | ttcggatgag | ttttgtcaag | ggttggggag | cagaatatca | ccggcaggat | gtaaccagca |
| 1741 | ccccatgttg | gattgagatt | catcttcatg | ggcctcttca | gtggctggat | aaagtcctta |
| 1801 | ctcagatggg | ctcccctctg | aaccccatat | cttctgtttc | ataatgcaga | agtattcttt |
| 1861 | tcaattatat | tgttagtgga | cttgttttaa | ttttagagaa | actttgagta | cagatactgt |
| 1921 | gagcttacat | tgaaaacaga | tattacagct | tattttttc | tacataattg | tgaccaatac |
| 1981 | atttgtattt | tgtgatgaat | ctacatttgt | ttgtattcat | gttcatgtga | ttaactctta |
| 2041 | gaagtgttgt | aaaagatgca | gagtaagtat | tatgccccag | ttcagaaatt | tggcattgat |
| 2101 | cttaaactgg | aacatgcttt | tactttattg | ccctaacaat | tttttattaa | atttatttga |
| 2161 | aaatgcatca | catgatgaaa | aattatagta | gcttataaga | gggcatatac | agtgaagagt |
| 2221 | aagttttccc | tcctactctc | gatcttccag | aagctgtact | tttaccagtt | tctttgtccc |
| 2281 | accaacttaa | aaaaaaaaag | tacaattcat | tgttttgcaa | aagtgtatgg | taggggctta |
| 2341 | aaagaaacta | taaagtttta | tttgaatgaa | cactatgcac | tgctgtaact | ggtagtgttc |
| 2401 | agtaaaagca | aaatgatagt | tttctagatg | acataaaatt | tacatttaat | acagataagt |
| 2461 | gttcttcagt | gtaatgtgac | ttcatgctat | atatcttttg | taagacattt | ccttttttaa |
| 2521 | aaaaattttt | gcaaataact | gatctcaagt | atatgtcatt | tactcaaaat | ctgtcataag |
| 2581 | cattacttta | tagctagtga | cagtgcatgc | acagccttgt | tcaactatgt | ttgctgcttt |
| 2641 | tggacaatgt | tgcaagaact | ctatttttga | catgcattaa | tcttttattt | tgcactttta |
| 2701 | tgggtgacag | tttttagcat | aacctttgat | aaaatacact | caagtgactt | ggacttagat |
| 2761 | gcttatcctt | acgtccttgg | taccttttt | gtattaacaa | acactgcaat | ttatagatta |
| 2821 | catttgtagg | aagttatgct | tttttctggt | ttttgtttta | ctttcaacct | aggttataag |
| 2881 | actgttattc | tatagctcca | acttaaggtg | ccttttttaat | tccctacagt | tttatgggtg |
| 2941 | ttatcagtgc | tggagaatca | tgtagttaat | cccattgctc | ttacaagtgt | cagcttactt |
| 3001 | gtatcagcct | ccctacgcaa | ggacctatgc | actggagccg | taggaggctc | ttcagttggg |
| 3061 | ccccaaggat | aaggctactg | atttgatact | aaatgaatca | gcagtggatg | tagggatagc |
| 3121 | tgattttaaa | acactcggct | gggcacagtg | gctcacacct | gtaatcccag | cactttggga |
| 3181 | ggctgaggca | ggcagatcat | gatgtcagga | gtttgagacc | agcctggcca | atatggtgaa |
| 3241 | accctgtctc | tacaaaaaat | acaaaaatta | gctgggcatg | gtggtgcgtg | cctgaagtcc |
| 3301 | cagctactcg | ggaagctgag | gcagaagaat | cacttgaacc | tgggaggcgg | aggttgtggt |
| 3361 | gagccgagat | cgcaccactg | cactccagcc | tgggcgacag | agcgagactc | tgcctcaaaa |
| 3421 | aacaaaacaa | aacaaaacac | tcacccatca | acgaatatag | actcttctct | catttatcga |
| 3481 | tgatcctctt | tttccatttt | ttaagtactt | atgtggaagc | tagtctccca | aaacacaatc |
| 3541 | tttagagaga | aaagacatga | acgaactcca | aaatatccat | ttaatcaatc | atgtttttgg |
| 3601 | ctttggataa | agaactttga | accagttttt | ttctcaggag | ctgtcaaatg | gacacttaat |
| 3661 | tatgacatga | gaatgaagaa | attattttgg | aaaaaaaaaa | tgacctaatt | tacctatcag |
| 3721 | tgaaagcttt | attttctggt | gccttttgaa | agtatatgga | gtcatatcat | tcttctgttt |
| 3781 | aaaatgttag | tttggtttga | ctttccactt | tgtcctttct | gctcttgtga | agaaaaaaaa |
| 3841 | aagcattttc | gaggaaagaa | ttatgcaatt | tcttttgttt | tctgtgtcat | tatttattgc |
| 3901 | tttttcaatg | tgcagccagt | ggatggtttt | agttctttca | gatgaactgc | catttgtgtt |
| 3961 | tcagctcaca | gttctttgct | gggtaaaaga | aatactttct | gacagtcacc | tgagccttaa |
| 4021 | atgtaagtat | tacatgacat | gcattctgtt | tcttccagag | ttctgtctgc | cacacgaaag |
| 4081 | agaatatttg | cttacttgat | agaactttgg | cattttcatc | attcttttac | ttaaccaggc |
| 4141 | ttatggcatg | atctctggaa | caaatttgta | ggaaaaaatt | actccaattg | aatgactgat |
| 4201 | gtatgtaatc | aacttcattg | ggctgcagta | aactagtgga | aattagagag | ttgttttatt |
| 4261 | ggtgttttct | actgtgagtt | aattaaaaat | tgtttttatt | tggggtcatt | atgtcacagt |
| 4321 | cttgagttaa | caagatctta | cgtgattggc | cttttctttg | ttttctctta | ggagttgtgt |
| 4381 | ctcatgaatg | acagtactaa | agctattaac | aactaagagt | ttgacagaga | actataagcc |
| 4441 | tgttgtatct | cctaaaagtt | gtcaactccc | caccccttgga | ctttaaatga | aaattttatt |
| 4501 | cagtccagct | attcttacag | tccctaagga | ttttcatata | tctatgtata | ggagataaaa |
| 4561 | tttgctagta | agatttttaa | aaactggcta | gtgaaaggaa | agtacctctg | aaagaaacca |
| 4621 | ttttagcaaa | ttatggttat | atgttttaat | ttaatctaca | gaatgtttta | tagtaaaatt |
| 4681 | ctagcaccac | tagaataatc | acatagcatg | tacaatatat | ttatgctggc | tgaaaagaca |
| 4741 | gaatctggga | ataataaaat | tgcaaccagt | ttggtaatgc | aaacagcaga | atagaatgaa |
| 4801 | atctcagtaa | tgaattaaag | caacaaaaag | atattgattg | gcaaaaagca | agatataaga |
| 4861 | gattcatttg | cttaacattt | ctacataata | tttatggtct | ggtcagtatt | ggtctggtca |
| 4921 | gtattgcctg | gctgacgtga | aatgtaaact | agtaggcgtg | ttattgatct | gctaaaacta |
| 4981 | accctctttt | taagaggaga | tttaaggaag | acgtcaatca | aaatgtcaaa | tatgtgtgtc |
| 5041 | agaatataaa | taatttttca | cattgtattg | ttgctatata | aaaaaaataa | tagaattggt |
| 5101 | tgggtttctg | aggtgaaatc | cagagtaaga | gtactagaca | gttcaacaag | ccacatctaa |
| 5161 | tggcacagat | agaggatgta | gctattttat | acctttcata | acatttgaga | gtaagatatc |
| 5221 | cttcaggatg | tgaagtgatt | attaagtact | catacctgaa | atctgttgtc | aagattagaa |
| 5281 | ctggggttca | tgttaaaaac | cttccatatt | acctgagggt | acctgtgggg | aacagttcct |
| 5341 | tcccctgtgt | ggtagtattt | tgttggaaga | gaatgtttat | acaaaaaatg | aaattcttcc |
| 5401 | aacagcagag | aaactctaaa | aagtttgata | gtacctatca | aagtgctgta | cttctgtgat |
| 5461 | agagaacatc | tgatgtacca | atttagatct | atttctttat | actttttcta | atcaattgct |
| 5521 | taatagtact | ttggatgatt | atcacctttg | ccacttaaaa | tatataaata | tccttttttac |
| 5581 | ttcatgagga | aggaagaatt | ttttgataat | tactgagttc | agccttttgt | gatgacttat |
| 5641 | attttggact | tacattttaa | ctttaaagaa | tgtcagatcc | cttctttgtc | ttactagtta |
| 5701 | aatcctcacc | taatctcttg | ggtatgaata | taaatgtgtg | tcatcgttat | attgttcagc |
| 5761 | tagatgagca | agtatcttag | ggtagtaggt | agcctggtgg | ttttagaagt | gtttggtgat |
| 5821 | ttttatggag | agagttttcc | taagtggtgg | tttataggtg | gtatcagata | ttattagggc |
| 5881 | agctttttgg | ggagtaatct | caggtctccc | agagcagcag | catttttctc | attgatataa |
| 5941 | gtaagattct | taggagcttt | tcttatcaca | caagatgcct | gaatcgaatg | tgagaattga |

TABLE 1-continued

```
6001 aggcatttct tctgcataaa caaagaattc tacctgctgg acagaaacct ggaaagttct
6061 ttggaattcg ctgaattaca gtttagtatg tcctgattac agagtgacaa tatttatcaa
6121 gcctttgtta tattggatta tcttctctct taaaatacaa ctgtattata attgaaatga
6181 cagcccaaaa ttggatggtt taccaaaacc aatgaaaggg atttcacaca tcaattttta
6241 tttctgtttt gaagagcaca tgctatataa taattgctag tagcaactgc agtaaaacag
6301 gtgataagtt attttctctg aaaagatcca gtcctagagc aggattcttc gatcattcat
6361 ggcagagtga aaaaggtttg tatggttctt gtccaaataa ctcagttctt aaaattctta
6421 aaatgatcgt aaaccattat cctttaaagg tttatttgaa gatgctgtta aagtacagaa
6481 ttttgtgtac aggtagattt ttccgtccct cattaatagt gccttcttaa ttaatacaga
6541 ctggtgttag ctataacaaa actccagtaa ggccaaagaa tcccaagttc tttgtggaaa
6601 aaaaaaaaaa atcttttagg gtcagatttt cccttctaat atcattgaag atgatgttgc
6661 attgatttat tcataaagta ttttaactat aggaactcta gaagataatg gttaggcaag
6721 tgattttttt tttaaatatg gttggcgtaa gttgtatttt gaaattcact tattttaaaa
6781 tcgaagagga ttgtaatcat ggaaatagaa tgtttgtatc tacctgccca cattttctta
6841 aaaagatatt tcatatacag ataatgaaga ccaagctagt ggctgcactg taggtctgct
6901 gcttatttgt atttgttgtg cttctgttta tgttgtagaa gctgaaattc tagcaacatg
6961 cttcaattct gttattttga tacttatgaa aatgtattag gttttactat attgtgcttt
7021 tgaaagccat aactcttaag aactttgttt ttgcatattg tttgctaatt ctttacttta
7081 ataaacctca aaacctg
```

SEQ ID NO: 165 Human SMAD5 transcript variant 3 cDNA sequence
(NM_001001420.2; CDS: 288-1685)

```
   1 atccgggtcc tgggcgagcg ggcgccgtgc gcgtgtcccg cggccgagct gctaataaag
  61 ttgcagcgag gagaagcgca gcgacggcgt cgggagagcg cgcctagccg gctcgcgaga
 121 cttgacccaa tgaaagaagc atatggcact tgtgaagata aatgttactc ctcccttttt
 181 aattggaact tctgcttagg acctgtgtat gacgtttcac ctgtgatctg ttctttcggt
 241 agccactgac tttgagttac aggaaggtct ccgaagattt gtgtcaaatg acgtcaatgg
 301 ccagcttgtt ttcttttact agtccagcag taaagcgatt gttgggctgg aaacaaggtg
 361 atgaggagga gaaatgggca gaaaaggcag ttgatgcttt ggtgaagaaa ctaaaaaaga
 421 aaaagggtgc catggaggaa ctggagaaag ccttgagcag tccaggacag ccgagtaaat
 481 gtgtcactat tcccagatct ttagatggac gcctgcaggt ttctcacaga aaaggcttac
 541 cccatgttat atattgtcgt gtttggcgct ggccggattt gcagagtcat catgagctaa
 601 agccgttgga tatttgtgaa tttccttttg gatctaagca aaaagaagtt tgtatcaacc
 661 cataccacta taagagagtg gagagtccag tcttacctcc agtattagtg cctcgtcata
 721 atgaattcaa tccacaacac agccttctgg ttcagtttag gaacctgagc cacaatgaac
 781 cacacatgcc acaaaatgcc acgtttccag attctttcca ccagcccaac aacactcctt
 841 ttcccttatc tccaaacagc ccttatcccc cttctcctgc tagcagcaca tatcccaact
 901 ccccagcaag ttctggacca ggaagtccat ttcagctccc agctgatacg cctcctcctg
 961 cctatatgcc acctgatgat cagatgggtc aagataattc ccagcctatg gatacaagca
1021 ataatatgat tcctcagatt atgcccagta tatccagcag ggatgttcag cctgttgcct
1081 atgaagagcc taaacattgg tgttcaatag tctactatga attaaacaat cgtgttggag
1141 aagcttttca tgcatcttct actagtgtgt tagtagatgg attcacagat ccttcaaata
1201 acaaaaagtag attctgcttg ggtttgttgt caaatgttaa tcgtaattcg acaattgaaa
1261 acactaggcg acatattgga aaaggtgttc atctgtacta tgttggtgga gaggtgtatg
1321 cggaatgcct cagtgacagc agcatatttg tacagagtag gaactgcaac tttcatcatg
1381 gctttcatcc caccactgtc tgtaagattc ccagcagctg cagcctcaaa atttttaaca
1441 atcaggagtt tgctcagctt ctggctcaat ctgtcaacca tgggtttgag gcagtatatg
1501 agctcaccaa aatgtgtacc attcggatga gttttgtcaa gggttgggga gcagaatatc
1561 accggcagga tgtaaccagc accccatgtt ggattgagat tcatcttcat gggcctcttc
1621 agtggctgga taaagtcctt actcagatgg gctcccctct gaaccccata tcttctgttt
1681 cataatgcag aagtattctt ttcaattata ttgttagtgg acttgtttta attttagaga
1741 aactttgagt acagatactg tgagcttaca ttgaaaacag atattacagc ttattttttt
1801 ctacataatt gtgaccaata catttgtatt ttgtgatgaa tctacatttg tttgtattca
1861 tgttcatgtg attaactctt agaagtgttg taaaagatgc agagtaagta ttatgcccca
1921 gttcagaaat ttggcattga tcttaaactg gaacatgctt ttactttatt gccctaacaa
1981 tttttttatta aatttatttg aaaatgcatc acatgatgaa aaattatagt agcttataag
2041 agggcatata cagtgaagag taagttttcc ctcctactct cgatcttcca gaagctgtac
2101 ttttaccagt ttctttgtcc caccaactta aaaaaaaaaa gtacaattca ttgttttgca
2161 aaagtgtatg gtaggggctt aaaagaaact ataaagtttt atttgaatga acactatgca
2221 ctgctgtaac tggtagtgtt cagtaaaagc aaaatgatag ttttctagat gacataaaat
2281 ttacatttaa tacagataag tgttcttcag tgtaatgtga cttcatgcta tatatctttt
2341 gtaagacatt tcctttttta aaaaaatttt tgcaaataac tgatctcaag tatatgtcat
2401 ttactcaaaa tctgtcataa gcattacttt atagctagtg acagtgcatg cacagccttg
2461 ttcaactatg tttgctgctt ttggacaatg ttgcaagaac tctatttttg acatgcatta
2521 atcttttatt ttgcactttt atgggtgaca gtttttagca taacctttga taaaatacac
2581 tcaagtgact tggacttaga tgcttatcct tacgtccttg gtaccttttt tgtattaaca
2641 aacactgcaa tttatagatt acatttgtag gaagttatgc ttttttctgg tttttgtttt
2701 actttcaacc taggttataa gactgttatt ctatagctcc aacttaaggt gcctttttaa
2761 ttccctacag ttttatgggt gttatcagtg ctggagaatc atgtagttaa tcccattgct
2821 cttacaagtg tcagcttact tgtatcagcc tccctacgca aggacctatg cactggagcc
2881 gtaggaggct cttcagttgg gccccaagga taaggctact gatttgatac taaatgaatc
2941 agcagtggat gtagggatag ctgattttaa aacactcggc tgggcacagt ggctcacacc
3001 tgtaatccca gcactttggg aggctgaggc aggcagatca tgatgtcagg agtttgagac
3061 cagcctggcc aatatggtga aaccctgtct ctacaaaaaa tacaaaaatt agctgggcat
3121 ggtggtgcgt gcctgaagtc ccagctactc gggaagctga ggcagaagaa tcacttgaac
3181 ctgggaggcg gaggttgtgg tgagccgaga tcgcaccact gcactccagc ctgggcgaca
3241 gagcgagact ctgcctcaaa aaacaaaaca aaacaaaaca ctcacccatc aacgaatata
3301 gactcttctc tcatttatcg atgatcctct ttttccattt tttaagtact tatgtggaag
3361 ctagtctccc aaaacacaat ctttagagag aaaagacatg aacgaactcc aaaatatcca
3421 tttaatcaat catgtttttg gctttggata aagaactttg aaccagtttt tttctcagga
```

TABLE 1-continued

```
3481 gctgtcaaat ggacacttaa ttatgacatg agaatgaaga aattattttg gaaaaaaaaa
3541 atgacctaat ttacctatca gtgaaagctt tattttctgg tgccttttga aagtatatgg
3601 agtcatatca ttcttctgtt taaaatgtta gtttggtttg actttccact ttgtcctttc
3661 tgctcttgtg aagaaaaaaa aaagcatttt cgaggaaaga attatgcaat ttcttttgtt
3721 ttctgtgtca ttatttattg ctttttcaat gtgcagccag tggatggttt tagttctttc
3781 agatgaactg ccatttgtgt ttcagctcac agttctttgc tgggtaaaag aaatactttc
3841 tgacagtcac ctgagcctta aatgtaagta ttacatgaca tgcattctgt ttcttccaga
3901 gttctgtctg ccacacgaaa gagaatattt gcttacttga tagaactttg gcattttcat
3961 cattctttta cttaaccagg cttatggcat gatctctgga acaaatttgt aggaaaaaat
4021 tactccaatt gaatgactga tgtatgtaat caacttcatt gggctgcagt aaactagtgg
4081 aaattagaga gttgttttat tggtgttttc tactgtgagt taattaaaaa ttgtttttat
4141 ttggggtcat tatgtcacag tcttgagtta acaagatctt acgtgattgg ccttttcttt
4201 gttttctctt aggagttgtg tctcatgaat gacagtacta aagctattaa caactaagag
4261 tttgacagag aactataagc ctgttgtatc tcctaaaagt tgtcaactcc ccaccccttgg
4321 actttaaatg aaaattttat tcagtccagc tattcttaca gtccctaagg attttcatat
4381 atctatgtat aggagataaa atttgctagt aagattttta aaaactggct agtgaaagga
4441 aagtacctct gaaagaaacc attttagcaa attatggtta tatgttttaa tttaatctac
4501 agaatgtttt atagtaaaat tctagcacca ctagaataat cacatagcat gtacaatata
4561 tttatgctgg ctgaaaagac agaatctggg aataataaaa ttgcaaccag tttggtaatg
4621 caaacagcag aatagaatga aatctcagta atgaattaaa gcaacaaaaa gatattgatt
4681 ggcaaaaagc aagatataag agattcattt gcttaacatt tctacataat atttatggtc
4741 tggtcagtat tggtctggtc agtattgcct ggctgacgtg aaatgtaaac tagtaggcgt
4801 gttattgatc tgctaaaact aaccctcttt ttaagaggag atttaaggaa gacgtcaatc
4861 aaaatgtcaa atatgtgtgt cagaatataa ataattttttc acattgtatt gttgctatat
4921 aaaaaaaata atagaattgg ttgggtttct gaggtgaaat ccagagtaag agtactagac
4981 agttcaacaa gccacatcta atggcacaga tagaggatgt agctatttta tacctttcat
5041 aacatttgag agtaagatat ccttcaggat gtgaagtgat tattaagtac tcatacctga
5101 aatctgttgt caagattaga actggggttc atgttaaaaa ccttccatat tacctgaggg
5161 tacctgtggg gaacagttcc ttcccctgtg tggtagtatt ttgttggaag agaatgttta
5221 tacaaaaaat gaaattcttc caacagcaga gaaactctaa aaagtttgat agtacctatc
5281 aaagtgctgt acttctgtga tagagaacat ctgatgtacc aatttagatc tatttcttta
5341 tactttttct aatcaattgc ttaatagtac tttggatgat tatcaccttt gccacttaaa
5401 atatataaat atccttttta cttcatgagg aaggaagaat tttttgataa ttactgagtt
5461 cagccttttg tgatgactta tattttggac ttacatttta actttaaaga atgtcagatc
5521 ccttctttgt cttactagtt aaatcctcac ctaatctctt gggtatgaat ataaatgtgt
5581 gtcatcgtta tattgttcag ctagatgagc aagtatctta gggtagtagg tagcctggtg
5641 gttttagaag tgtttggtga tttttatgga gagagtttttc ctaagtggtg gtttataggt
5701 ggtatcagat attattaggg cagctttttg gggagtaatc tcaggtctcc cagagcagca
5761 gcatttttct cattgatata agtaagattc ttaggagctt ttcttatcac acaagatgcc
5821 tgaatcgaat gtgagaattg aaggcatttc ttctgcataa acaaagaatt ctacctgctg
5881 gacagaaacc tggaaagttc tttggaattc gctgaattac agtttagtat gtcctgatta
5941 cagagtgaca atatttatca agcctttgtt atattggatt atcttctctc ttaaaataca
6001 actgtattat aattgaaatg acagcccaaa attggatggt ttaccaaaac caatgaaagg
6061 gatttcacac atcaattttt atttctgttt tgaagagcac atgctatata ataattgcta
6121 gtagcaactg cagtaaaaca ggtgataagt tattttctct gaaaagatcc agtcctagag
6181 caggattctt cgatcattca tggcagagtg aaaaaggttt gtatggttct tgtccaaata
6241 actcagttct taaaattctt aaaatgatcg taaaccatta tcctttaaag gtttatttga
6301 agatgctgtt aaagtacaga attttgtgta caggtagatt tttccgtccc tcattaatag
6361 tgccttctta attaatacag actggtgtta gctataacaa aactccagta aggccaaaga
6421 atcccaagtt ctttgtggaa aaaaaaaaaa aatcttttag ggtcagattt tcccttctaa
6481 tatcattgaa gatgatgttg cattgattta ttcataaagt attttaacta taggaactct
6541 agaagataat ggttaggcaa gtgatttttt ttttaaatat ggttggcgta agttgtattt
6601 tgaaattcac ttattttaaa atcgaagagg attgtaatca tggaaataga atgtttgtat
6661 ctacctgccc acatttttctt aaaaagatat ttcatataca gataatgaag accaagctag
6721 tggctgcact gtaggtctgc tgcttatttg tatttgttgt gcttctgttt atgttgtaga
6781 agctgaaatt ctagcaacat gcttcaattc tgttattttg atacttatga aaatgtatta
6841 ggtttttacta tattgtgctt ttgaaagcca taactcttaa gaactttgtt tttgcatatt
6901 gtttgctaat tctttacttt aataaacctc aaaacctgc
```

SEQ ID NO: 166 Human SMAD5 amino acid sequence (NP_001001419.1, NP_001001420.1, NP_005894.3)

```
  1 mtsmaslfsf tspavkrllg wkqgdeeekw aekavdalvk klkkkkgame elekalsspg
 61 qpskcvtipr sldgrlqvsh rkglphviyc rvwrwpdlqs hhelkpldic efpfgskqke
121 vcinpyhykr vespvlppvl vprhnefnpq hsllvqfrnl shnephmpqn atfpdsfhqp
181 nntpfplspn spyppspass typnspassg pgspfqlpad tpppaymppd dqmgqdnsqp
241 mdtsnnmipq impsissrdv qpvayeepkh wcsivyyeln nrvgeafhas stsvlvdgft
301 dpsnnksrfc lgllsnvnrn stientrrhi gkgvhlyyvg gevyaeclsd ssifvqsrnc
361 nfhhgfhptt vckipsscsl kifnnqefaq llaqsvnhgf eavyeltkmc tirmsfvkgw
421 gaeyhrqdvt stpcwieihl hgplqwldkv ltqmgspinp issvs
```

SEQ ID NO: 167 Mouse SMAD5 transcript variant 1 cDNA sequence (NM_008541.3, CDS: 288-1685)

```
  1 atcatccggg tccccggcga gcgggcgccg agcgcttgtc ccggggccga gctgctaata
 61 aagttgcggc gcgtgcacag cgcggcgacg gcgtgaggag agcgcgcctg ggcggcgggg
121 aggacttgca ctaagaagaa gcctatggca cctgtcaagt taaatgtcac tccccgcctc
181 cacttggact ttctgcttaa gacctgcatg tgacttttca cctgcgagcc acgcttttgg
241 tatctactga ctttgattac aggaaagtgt ctgaagattt gtatcaaatg acgtcaatgg
301 ccagcttgtt ttctttcact agtccagccg tgaagcgatt gttgggctgg aaacaaggtg
361 acgaggaaga gaaatggca gaaaaggcag tggatgcttt agtgaaaaag ctgaagaaga
421 agaagggtgc tatggaggag ctggagaaag ccttgagcag cccaggacag ccaagcaagt
```

TABLE 1-continued

| | | | | | | |
|---|---|---|---|---|---|---|
| 481 | gtgtcacgat | ccccaggtcc | ttggatggac | gtctgcaagt | ttctcacagg | aaaggcttgc |
| 541 | cccatgttat | atattgccgt | gtttggcgct | ggccagattt | gcagagccat | cacgagctaa |
| 601 | aaccattgga | tatttgtgaa | tttccttttg | gatctaagca | aaaggaagtt | tgtatcaatc |
| 661 | cataccacta | taagagagtg | gagagtccag | tcttacctcc | agtattagtg | cctcgtcaca |
| 721 | atgaattcaa | tccacaacac | agccttctgg | ttcagttcag | gaacctgagc | cacaatgaac |
| 781 | cgcacatgcc | acaaaacgcc | acgtttcccg | attctttcca | ccaacccaac | aacgctcctt |
| 841 | tccccttatc | tcctaacagc | ccctatcctc | cttcccctgc | tagcagcaca | tatcccaact |
| 901 | ccccagcaag | ctctggacct | ggaagtccat | ttcaactccc | agctgacacc | cctccccctg |
| 961 | cctatatgcc | acctgatgat | cagatggccc | cagataattc | ccagcctatg | gatacaagca |
| 1021 | gtaacatgat | tcctcagacc | atgcccagca | tatccagcag | agatgttcag | cctgtcgcct |
| 1081 | atgaggagcc | caaacactgg | tgttcgattg | tctactatga | attaaacaat | cgtgttgggg |
| 1141 | aagcttttca | tgcatcttct | actagtgtgt | tagtagatgg | atttacagat | ccttcaaata |
| 1201 | acaaaagtag | attctgcctg | ggattgttgt | caaatgttaa | tcgtaattca | actattgaaa |
| 1261 | acactaggcg | gcatattgga | aaaggtgttc | atctatacta | cgttggtggg | gaggtgtacg |
| 1321 | ctgagtgtct | tagtgacagc | agcatctttg | ttcagagtag | gaactgcaac | tttcaccatg |
| 1381 | gcttccatcc | caccaccgtc | tgtaagatcc | ccagcagctg | cagcctcaag | atttttaaca |
| 1441 | atcaggagtt | tgctcagctt | ctggctcagt | cagtcaacca | tggattcgag | gctgtgtatg |
| 1501 | agctcaccaa | gatgtgtacc | attcgaatga | gctttgtcaa | gggctgggga | gcagagtacc |
| 1561 | accgacagga | cgtcaccagt | actccctgct | ggattgagat | tcacctccac | gggcctctgc |
| 1621 | agtggctgga | taaagtcctt | actcagatgg | gctctccgct | gaaccccatt | tcttctgttt |
| 1681 | catagtgcag | aagtattctt | tcaactatat | ttttagtgga | cttgttttaa | ttttagagga |
| 1741 | atttccagta | cagatgctgt | gagctgacat | ggaaaacaga | tattattttt | tctacgtaat |
| 1801 | tgtgaccaac | acatttgtat | tttatgatga | tattacattt | gtttgtattc | gtgttcattg |
| 1861 | tgattaactt | tcaaaagtat | tgtaaacgat | gtagagtatt | ttgcccctgt | tgaaatgttt |
| 1921 | agcattgatc | ttaaactgga | acgtactttt | tcttattgtc | ccaacgtttt | ttaatttgtt |
| 1981 | aaattttttt | tacaaagtag | ttcatcacat | aatgaaattt | tatcctataa | gagaacatat |
| 2041 | attgtggaaa | gcagtagatg | atatttctct | gggaatttct | ttgccttacc | acctttgaaa |
| 2101 | aagcatacat | tgtttgcaaa | acctcaaagt | agggcttgct | taaaggaaac | tgttgaatct |
| 2161 | tgtttgaagg | acactgcagt | cctaacgtgt | tcagtgaaag | caaggtggta | gatttctgga |
| 2221 | cgtcatacat | ttacatttaa | tataggtaat | attcatcagt | gtaatgtgac | ttcatgccat |
| 2281 | atatattttg | taaaacaatt | ccttttttaaa | aacttcaagt | atttctcatt | tactcaaatt |
| 2341 | tgttgtaagt | cctacttaac | agttagttac | tatgtgctct | gtggccttgt | tcagcattgt |
| 2401 | ttgctgcttt | gggccaacaa | ttcaagaact | ctaattttcc | tgtgcattaa | tcttttcatt |
| 2461 | ttgcactttt | atgggtgact | gtcttagtgt | agcctctggt | aaaatactat | taggtggcct |
| 2521 | ggttttagag | ctcctcctcg | ctgccttggc | actcctttgt | gcaacacgac | cacttagaga |
| 2581 | tgacagctgt | gagctgtgct | gctttttcta | gcctttaatt | tccaatgtag | tttataatgt |
| 2641 | tgttcttcta | tagctccagc | taaggtgcct | gttagtcccc | tacaatgtta | tgagcattat |
| 2701 | tgacattgaa | aggttatgta | tgtatgaata | cctttgctcc | ttaccagact | tgtcatacaa |
| 2761 | ggactcgtgc | agtgtagcca | gtagaggctc | tttggttggc | ccaagaatga | ggctgttggt |
| 2821 | gtaagtgaat | cacaataggg | attgggatag | ttcatgtcat | atgtcatata | gcaagacaat |
| 2881 | gtagagtgta | ggcttgtctc | tctgcatcaa | cgctctgcct | ctttcttttt | atccttttag |
| 2941 | aacctacatg | gacgctaatc | tccacaacac | tgttggatgt | gaacactctt | aagacactca |
| 3001 | tctagttcac | tgtgccttgt | ccttaggact | cttaaccact | ttctagggag | cagttatggc |
| 3061 | ctgagatgga | cagtcatggc | ctgagaatga | agacactact | ttgataaaga | aaaaggcctc |
| 3121 | atttgcctat | cagagtgaga | aaggtttttt | tctggtgcct | tttgaaaata | tacagagcca |
| 3181 | cttggttctt | ctgctgaaaa | tgtaattttg | gtttgacttt | ttagagtgcc | cttcctgcct |
| 3241 | ttatgaggaa | aacagctatt | tttttttttg | gggggggga | ttccttttgt | tttctgtgcc |
| 3301 | attatttatt | gcctttcaga | gtgcaaccat | tgggtggctt | tgctccttca | gagagggctc |
| 3361 | cttgatagcc | ttcagtagct | tgagctgtag | acataagtat | tccatagcaa | gagtgtgtca |
| 3421 | gctccatgag | agagatgtct | gctttatagc | cgaggcagaa | accgttcatg | ttcctttact |
| 3481 | tggcagcctt | caggaacagg | tttgtaagaa | cgtgtcttga | gttgagtgag | tgtatgtctg |
| 3541 | tgagctctgc | tgaagtctgg | acacaagggc | cttgcctgct | cctttttca | gcagtgggtt |
| 3601 | acatgttgtc | tctccacagt | cttcatgtca | taggtctcgg | acttgcagag | tcctatgtgg |
| 3661 | cctgccatct | gtacagtggc | aggactgaag | ctctgagctg | ttctgaggtt | catggagaaa |
| 3721 | tcccaaccta | ttctgtggtc | agtaaatgga | gactgtgtag | tctacctgct | cctgtactgt |
| 3781 | ccttactgta | tgtaaggata | tacagacgcc | tgtgggtagg | cagtactcac | agtgagatga |
| 3841 | agacagcaag | tgtgcactga | accacagagg | gcagggagta | gggcctctga | agaagccacc |
| 3901 | agaccagacc | agtgccggta | cagtctttgt | cagagatggc | tctgatgggg | cccagactga |
| 3961 | ccctgaccat | gctgagttgc | tgagggtagc | cttcagttct | ctaccctctg | aagtgctagg |
| 4021 | atgacagaca | tccgccatca | tacccagctt | ccgtggtgct | aaggatcagc | ctcagtcttc |
| 4081 | aggcgtgcta | ggcatgtact | ttgccaagta | tttagtatac | aaaatacatt | agtatctgcc |
| 4141 | agggaaaaaa | gatttgcaaa | taataaagat | tgccatcagt | ttgataaatg | ttgtaaatgg |
| 4201 | aagaatcaaa | atctcagcga | tggattacag | caacaagatg | ctgcctagga | aaagcaggac |
| 4261 | caagaggtac | atttgactag | tataccttca | gcgtagcgtg | atgacctcac | tgatgtcacc |
| 4321 | caactgaact | taagggctgt | aagtaggcgt | gctgtgggcc | ttccagaact | agagaaaatt |
| 4381 | ataggaggaa | gtcagttcta | aagtatcaaa | agctgggtaa | tggtggcaca | tgcctttgat |
| 4441 | tctagcactc | gggaagcagg | ggctagccta | gtctacagag | caacttctac | acagagaaac |
| 4501 | tgtcttggag | gaaaataaaa | aaagaaaagt | caaagagcaa | acaaatagaa | cagagtagga |
| 4561 | atccgtgtcc | cctttttct | atgtttcacg | gttgcaggtg | taagaaaagt | agtcatagat |
| 4621 | gtggctgagt | ttctaagatg | aaaccagtag | taagattgct | aaatataaca | cttcaaccaa |
| 4681 | gttaaacacc | ctttgggggt | atgaatgaaa | gtaacactgc | aatatgaaat | gaaccgtgca |
| 4741 | agtaacactt | ggggttacct | cacagtctcc | ctatgcctga | gaggactgtg | ggaaacattt |
| 4801 | ccatcccctg | ccagtatcgc | cattgggagg | acagagtaga | tgaagaagtg | aagtcttact |
| 4861 | ggtccagggc | acgcctgtca | gcaatgccat | ttgtgcttct | gccacagaga | gcaccgagag |
| 4921 | gcttggctca | gtatcctcga | accttctctg | gtcacttccc | tggcagcact | tgggtccctg |
| 4981 | tcactcactg | gtctcttaaa | agtcccgtct | ctttgcttcc | taaagattct | ctaaaaaaat |
| 5041 | tactattttt | tatttctttt | ttaaaagtct | ttgttatttt | gttttgggat | acagtctctt |
| 5101 | tgtacagtcc | tggctggcct | ggaaattact | atgtaggcca | gcctcaaact | tgaagtaatt |
| 5161 | ctcttgcctc | tgcctctgga | gttctgggat | tacaggcatg | cactgcagag | tacagtgagc |
| 5221 | tctgatggct | tttaaaattc | agccccttttg | agggtttggt | tttagatcca | ttagctttgt |

TABLE 1-continued

```
5281 ctgaacccat ctttgtccgg ccgagtaaat cctctgctat ccggggtctc ggtagaaatg
5341 tgttctcagt atacatacga ctaaacattg gttgtttata ggtagcctca gatatttggt
5401 agagcatctt ttttgaaagt aatctccagc taggtgggta tttccctcac agcagtagga
5461 ttttcccttt aggagatacc agttcttcat ctttcttgtg aaaataatgc ctttatgggg
5521 agtgaagatt aaggagttgt ttctacacta acagaattct atttgatgga caacttggac
5581 agttctgtgg acttgggtgg gttctagtgt gctaagaagg ataacagtat ttaatagtgt
5641 ctgtcatcag gccttgctca tctccctgtc tagggctgta ggtcagtgct cgagcactta
5701 gcaggcatcg agtctagtgt tcagtgccca gcattgcaca gaactcagaa tatatctgta
5761 ctgaaactga agtgaccacc tacaaccagg tggtatgcca gaaccacaga aaggagattc
5821 acggtgatgt gtttaaagca ttgggctggt gacggttgct gtgtagtaat gacctcttcc
5881 tcagcaaaga gagtcctgga gcaggctgtc ctcagaagag ggaagggact ggtgtgctcc
5941 ttgtgcagat aacttagtgt ataaatcggc atgagtagct atcctttaag gatttgtttg
6001 aagttactct ttgtaaaaag ttgagaattt tgtgtgcagt tgggcacatg cttgcccttc
6061 ccccacccgc catagtcctg cctctcttgc tgtgaactgg tgtcagctac aacactccag
6121 ctaggtctga gctcttttga gagaaggtct cgtagagcac cattctcaga gagaagctaa
6181 agcatgggga gccttaggac ggtcaggcaa tgcactcttt accacggctg gctaaggctg
6241 cagcttgacc gtccttacct aaatcaggta agaatgtgat tacagagcga gtgcttgtgt
6301 tccccggcct gccttctccg aggaagatgc ttcatccgag gatgatgcag agcagacgat
6361 ggctgcactg taggtctgcc tccttctgtg tatgggttct gctgctgctt acggcatagg
6421 aaagtacact agcagcgtgc ttcaattctg ccatcttttg atacttataa aaatgtatta
6481 ggttttactg tattgtgctc tcaaagccat aactcttaag aaatttggtt tttttgcata
6541 ttgtttgcta atactttgtt ttaataaacc tcaaaatctg cttac
```

SEQ ID NO: 168 Mouse SMAD5 transcript variant 2 cDNA sequence
(NM_001164041.1; CDS: 691-2088)

```
   1 ggggccgagc tgctaataaa gttgcggcgc gtgcacagcg cggcgacggc gtgaggagag
  61 cgcgcctggg cggcggggag gtgagtgagg ggccccaggg cgggcgctcg gggcccggcg
 121 gagggacaag cgccggcggc agcggcccgc gtgaggctgg aggcctagag gctccccacg
 181 cgggacctga cggcacggga cggggctccg cgcagcgcgg gaggccccgg tgctaaggag
 241 gccccgcgcg gccgacgagg ccggcgcgga cgaggccgct gccacctcgg cgcgccaccg
 301 acgcccgggc ccgcgcgcgg agccgcgcag gcggcctagg ccgagcgcgc gccccgccgc
 361 tttgtgtctg ggagataagg atccgcgctt atcggtggga attacactcc ggccagccgg
 421 ctggcggcga cccgcccctg cgcccgcccg cccgcccgcc cgcccgctcg cccgcccgtc
 481 actctccgga cgtcgcagag gctccctcgc tgcgctaaac tttgtgactt gcactaagaa
 541 gaagcctatg gcacctgtca agttaaatgt cactccccgc ctccacttgg actttctgct
 601 taagacctgc atgtgacttt tcacctgcga gccacgcttt tggtatctac tgactttgat
 661 tacaggaaag tgtctgaaga tttgtatcaa atgacgtcaa tggccagctt gttttctttc
 721 actagtccag ccgtgaagcg attgttgggc tggaaacaag gtgacgagga agagaaatgg
 781 gcagaaaagg cagtggatgc tttagtgaaa aagctgaaga agaagaaggg tgctatggag
 841 gagctggaga aagccttgag cagcccagga cagccaagca agtgtgtcac gatccccagg
 901 tccttggatg gacgtctgca agtttctcac aggaaaggct tgccccatgt tatatattgc
 961 cgtgtttggc gctggccaga tttgcagagc catcacgagc taaaaccatt ggatatttgt
1021 gaatttcctt ttggatctaa gcaaaaggaa gtttgtatca atccatacca ctataagaga
1081 gtggagagtc cagtcttacc tccagtatta gtgcctcgtc acaatgaatt caatccacaa
1141 cacagccttc tggttcagtt caggaacctg agccacaatg aaccgcacat gccacaaaac
1201 gccacgtttc ccgattcttt ccaccaaccc aacaacgctc ctttcccctt atctcctaac
1261 agcccctatc ctccttcccc tgctagcagc acatatccca actccccagc aagctctgga
1321 cctggaagtc catttcaact cccagctgac acccctcccc ctgcctatat gccacctgat
1381 gatcagatgg ccccagataa ttcccagcct atggatacaa gcagtaacat gattcctcag
1441 accatgccca gcatatccag cagagatgtt cagcctgtcg cctatgagga gcccaaacac
1501 tggtgttcga ttgtctacta tgaattaaac aatcgtgttg gggaagcttt tcatgcatct
1561 tctactagtg tgttagtaga tggatttaca gatccttcaa ataacaaaag tagattctgc
1621 ctgggattgt tgtcaaatgt taatcgtaat tcaactattg aaaacactag gcggcatatt
1681 ggaaaaggtg ttcatctata ctacgttggt ggggaggtgt acgctgagtg tcttagtgac
1741 agcagcatct ttgttcagag taggaactgc aactttcacc atggcttcca tcccaccacc
1801 gtctgtaaga tccccagcag ctgcagcctc aagattttta acaatcagga gtttgctcag
1861 cttctggctc agtcagtcaa ccatggattc gaggctgtgt atgagctcac caagatgtgt
1921 accattcgaa tgagctttgt caagggctgg ggagcagagt accaccgaca ggacgtcacc
1981 agtactccct gctggattga gattcacctc cacgggcctc tgcagtggct ggataaagtc
2041 cttactcaga tgggctctcc gctgaacccc atttcttctg tttcatagtg cagaagtatt
2101 ctttcaacta tatttttagt ggacttgttt taattttaga ggaatttcca gtacagatgc
2161 tgtgagctga catggaaaac agatattatt ttttctacgt aattgtgacc aacacatttg
2221 tattttatga tgatattaca tttgtttgta ttcgtgttca ttgtgattaa ctttcaaaag
2281 tattgtaaac gatgtagagt attttgcccc tgttgaaatg tttagcattg atcttaaact
2341 ggaacgtact ttttcttatt gtcccaacgt tttttaattt gttaaatttt ttttacaaag
2401 tagttcatca cataatgaaa ttttatccta taagagaaca tatattgtgg aaagcagtag
2461 atgatatttc tctgggaatt tctttgcctt accacctttg aaaaagcata cattgtttgc
2521 aaaacctcaa agtagggctt gcttaaagga aactgttgaa tcttgtttga aggacactgc
2581 agtcctaacg tgttcagtga aagcaaggtg gtagatttct ggacgtcata catttacatt
2641 taatataggt aatattcatc agtgtaatgt gacttcatgc catatatatt ttgtaaaaca
2701 attccttttt aaaaacttca agtatttctc atttactcaa atttgttgta agtcctactt
2761 aacagttagt tactatgtgc tctgtggcct tgttcagcat tgtttgctgc tttgggccaa
2821 caattcaaga actctaattt tcctgtgcat taatcttttc attttgcact tttatgggtg
2881 actgtcttag tgtagcctct ggtaaaatac tattaggtgg cctggtttta gagctcctcc
2941 tcgctgcctt ggcactcctt tgtgcaacac gaccacttag agatgacagc tgtgagctgt
3001 gctgcttttt ctagccttta atttccaatg tagtttataa tgttgttctt ctatagctcc
3061 agctaaggtg cctgttagtc ccctacaatg ttatgagcat tattgacatt gaaaggttat
3121 gtatgtatga ataccttttgc tccttaccag acttgtcata caaggactcg tgcagtgtag
3181 ccagtagagg ctctttggtt ggcccaagaa tgaggctgtt ggtgtaagtg aatcacaata
3241 gggattggga tagttcatgt catatgtcat atagcaagac aatgtagagt gtaggcttgt
```

TABLE 1-continued

```
3301 ctctctgcat caacgctctg cctctttctt tttatccttt tagaacctac atggacgcta
3361 atctccacaa cactgttgga tgtgaacact cttaagacac tcatctagtt cactgtgcct
3421 tgtccttagg actcttaacc actttctagg gagcagttat ggcctgagat ggacagtcat
3481 ggcctgagaa tgaagacact actttgataa agaaaaaggc ctcatttgcc tatcagagtg
3541 agaaaggttt ttttctggtg ccttttgaaa atatacagag ccacttggtt cttctgctga
3601 aaatgtaatt ttggtttgac tttttagagt gcccttcctg cctttatgag gaaaacagct
3661 attttttttt ttggggggggg ggattccttt tgttttctgt gccattattt attgcctttc
3721 agagtgcaac cattgggtgg ctttgctcct tcagagaggg ctccttgata gccttcagta
3781 gcttgagctg tagacataag tattccatag caagagtgtg tcagctccat gagagagatg
3841 tctgctttat agccgaggca gaaaccgttc atgttccttt acttggcagc cttcaggaac
3901 aggtttgtaa gaacgtgtct tgagttgagt gagtgtatgt ctgtgagctc tgctgaagtc
3961 tggacacaag ggccttgcct gctccttttt tcagcagtgg gttacatgtt gtctctccac
4021 agtcttcatg tcataggtct cggacttgca gagtcctatg tggcctgcca tctgtacagt
4081 ggcaggactg aagctctgag ctgttctgag gttcatggag aaatcccaac ctattctgtg
4141 gtcagtaaat ggagactgtg tagtctacct gctcctgtac tgtccttact gtatgtaagg
4201 atatacagac gcctgtgggt aggcagtact cacagtgaga tgaagacagc aagtgtgcac
4261 tgaaccacag agggcaggga gtagggcctc tgaagaagcc accagaccag accagtgccg
4321 gtacagtctt tgtcagagat ggctctgatg gggcccagac tgaccctgac catgctgagt
4381 tgctgagggt agccttcagt tctctaccct ctgaagtgct aggatgacag acatccgcca
4441 tcatacccag cttccgtggt gctaaggatc agcctcagtc ttcaggcgtg ctaggcatgt
4501 actttgccaa gtatttagta tacaaaatac attagtatct gccagggaaa aaagatttgc
4561 aaataataaa gattgccatc agtttgataa atgttgtaaa tggaagaatc aaaatctcag
4621 cgatggatta cagcaacaag atgctgccta ggaaaagcag gaccaagagg tacatttgac
4681 tagtatacct tcagcgtagc gtgatgacct cactgatgtc acccaactga acttaagggc
4741 tgtaagtagg cgtgctgtgg gccttccaga actagagaaa attataggag gaagtcagtt
4801 ctaaagtatc aaaagctggg taatggtggc acatgccttt gattctagca ctcgggaagc
4861 aggggctagc ctagtctaca gagcaacttc tacacagaga aactgtcttg gaggaaaata
4921 aaaaaagaaa agtcaaagag caaacaaata gaacagagta ggaatccgtg tccccttttt
4981 tctatgtttc acggttgcag gtgtaagaaa agtagtcata gatgtggctg agtttctaag
5041 atgaaaccag tagtaagatt gctaaatata acacttcaac caagttaaac accctttggg
5101 ggtatgaatg aaagtaacac tgcaatatga aatgaaccgt gcaagtaaca cttggggtta
5161 cctcacagtc tccctatgcc tgagaggact gtgggaaaca tttccatccc ctgccagtat
5221 cgccattggg aggacagagt agatgaagaa gtgaagtctt actggtccag ggcacgcctg
5281 tcagcaatgc catttgtgct tctgccacag agagcaccga gaggcttggc tcagtatcct
5341 cgaaccttct ctggtcactt ccctggcagc acttgggtcc ctgtcactca ctggtctctt
5401 aaaagtcccg tctctttgct tcctaaagat tctctaaaaa aattactatt ttttatttct
5461 tttttaaaag tctttgttat tttgttttgg gatacagtct ctttgtacag tcctggctgg
5521 cctggaaatt actatgtagg ccagcctcaa acttgaagta attctcttgc ctctgcctct
5581 ggagttctgg gattacaggc atgcactgca gagtacagtg agctctgatg gcttttaaaa
5641 ttcagcccct ttgagggttt ggttttagat ccattagctt tgtctgaacc catctttgtc
5701 cggccgagta aatcctctgc tatccggggt ctcggtagaa atgtgttctc agtatacata
5761 cgactaaaca ttggttgttt ataggtagcc tcagatattt ggtagagcat ctttttttgaa
5821 agtaatctcc agctaggtgg gtatttccct cacagcagta ggattttccc tttaggagat
5881 accagttctt catctttctt gtgaaaataa tgcctttatg gggagtgaag attaaggagt
5941 tgtttctaca ctaacagaat tctatttgat ggacaacttg gacagttctg tggacttggg
6001 tgggttctag tgtgctaaga aggataacag tatttaatag tgtctgtcat caggccttgc
6061 tcatctccct gtctagggct gtaggtcagt gctcgagcac ttagcaggca tcgagtctag
6121 tgttcagtgc ccagcattgc acagaactca gaatatatct gtactgaaac tgaagtgacc
6181 acctacaacc aggtggtatg ccagaaccac agaaaggaga ttcacggtga tgtgtttaaa
6241 gcattgggct ggtgacggtt gctgtgtagt aatgacctct tcctcagcaa agagagtcct
6301 ggagcaggct gtcctcagaa gagggaaggg actggtgtgc tccttgtgca gataacttag
6361 tgtataaatc ggcatgagta gctatccttt aaggatttgt ttgaagttac tctttgtaaa
6421 aagttgagaa ttttgtgtgc agttgggcac atgcttgccc ttccccccacc cgccatagtc
6481 ctgcctctct tgctgtgaac tggtgtcagc tacaacactc cagctaggtc tgagctcttt
6541 tgagagaagg tctcgtagag caccattctc agagagaagc taaagcatgg ggagccttag
6601 gacggtcagg caatgcactc tttaccacgg ctggctaagg ctgcagcttg accgtcctta
6661 cctaaatcag gtaagaatgt gattacagag cgagtgcttg tgttccccgg cctgccttct
6721 ccgaggaaga tgcttcatcc gaggatgatg cagagcagac gatggctgca ctgtaggtct
6781 gcctccttct gtgtatgggt tctgctgctg cttacggcat aggaaagtac actagcagcg
6841 tgcttcaatt ctgccatctt ttgatactta taaaaatgta ttaggtttta ctgtattgtg
6901 ctctcaaagc cataactctt aagaaatttg gttttttttgc atattgtttg ctaatacttt
6961 gttttaataa acctcaaaat ctgcttac
```

SEQ ID NO: 169 Mouse SMAD5 transcript variant 3 cDNA sequence (NM_001164042.1; CDS: 311-1708)

```
  1 gccctttctc ctctgcgctt ctggctgcgc cgagccggga accctaagct ctgggaactt
 61 ccccggtggc ggccgtctta gggtcagagc atgctcagtg gcccggactt ttcggttgca
121 gaaggagctg gcggggatgg tcgaggactt gcactaagaa gaagcctatg gcacctgtca
181 agttaaatgt cactccccgc ctccacttgg actttctgct taagacctgc atgtgacttt
241 tcacctgcga gccacgcttt tggtatctac tgactttgat tacaggaaag tgtctgaaga
301 tttgtatcaa atgacgtcaa tggccagctt gttttctttc actagtccag ccgtgaagcg
361 attgttgggc tggaaacaag gtgacgagga agagaaatgg gcagaaaagg cagtggatgc
421 tttagtgaaa aagctgaaga agaagaaggg tgctatggag gagctggaga aagccttgag
481 cagcccagga cagccaagca agtgtgtcac gatccccagg tccttggatg gacgtctgca
541 agtttctcac aggaaaggct tgccccatgt tatatattgc cgtgtttggc gctggccaga
601 tttgcagagc catcacgagc taaaaccatt ggatatttgt gaatttcctt ttggatctaa
661 gcaaaaggaa gtttgtatca atccatacca ctataagaga gtggagagtc cagtcttacc
721 tccagtatta gtgcctcgtc acaatgaatt caatccacaa cacagccttc tggttcagtt
781 caggaacctg agccacaatg aaccgcacat gccacaaaac gccacgtttc ccgattcttt
841 ccaccaaccc aacaacgctc ctttcccctt atctcctaac agcccctatc ctccttcccc
```

TABLE 1-continued

| | | | | | | |
|---|---|---|---|---|---|---|
| 901 | tgctagcagc | acatatccca | actccccagc | aagctctgga | cctggaagtc | catttcaact |
| 961 | cccagctgac | acccctcccc | ctgcctatat | gccacctgat | gatcagatgg | ccccagataa |
| 1021 | ttcccagcct | atggatacaa | gcagtaacat | gattcctcag | accatgccca | gcatatccag |
| 1081 | cagagatgtt | cagcctgtcg | cctatgagga | gcccaaacac | tggtgttcga | ttgtctacta |
| 1141 | tgaattaaac | aatcgtgttg | gggaagcttt | tcatgcatct | tctactagtg | tgttagtaga |
| 1201 | tggatttaca | gatccttcaa | ataacaaaag | tagattctgc | ctgggattgt | tgtcaaatgt |
| 1261 | taatcgtaat | tcaactattg | aaaacactag | gcggcatatt | ggaaaaggtg | ttcatctata |
| 1321 | ctacgttggt | ggggaggtgt | acgctgagtg | tcttagtgac | agcagcatct | ttgttcagag |
| 1381 | taggaactgc | aactttcacc | atggcttcca | tcccaccacc | gtctgtaaga | tccccagcag |
| 1441 | ctgcagcctc | aagattttta | acaatcagga | gtttgctcag | cttctggctc | agtcagtcaa |
| 1501 | ccatggattc | gaggctgtgt | atgagctcac | caagatgtgt | accattcgaa | tgagctttgt |
| 1561 | caagggctgg | ggagcagagt | accaccgaca | ggacgtcacc | agtactccct | gctggattga |
| 1621 | gattcacctc | cacgggcctc | tgcagtggct | ggataaagtc | cttactcaga | tgggctctcc |
| 1681 | gctgaacccc | atttcttctg | tttcatagtg | cagaagtatt | ctttcaacta | tatttttagt |
| 1741 | ggacttgttt | taattttaga | ggaatttcca | gtacagatgc | tgtgagctga | catggaaaac |
| 1801 | agatattatt | ttttctacgt | aattgtgacc | aacacatttg | tattttatga | tgatattaca |
| 1861 | tttgtttgta | ttcgtgttca | ttgtgattaa | ctttcaaaag | tattgtaaac | gatgtagagt |
| 1921 | attttgcccc | tgttgaaatg | tttagcattg | atcttaaact | ggaacgtact | ttttcttatt |
| 1981 | gtcccaacgt | tttttaattt | gttaaatttt | ttttacaaag | tagttcatca | cataatgaaa |
| 2041 | ttttatccta | taagagaaca | tatattgtgg | aaagcagtag | atgatatttc | tctgggaatt |
| 2101 | tctttgcctt | accacctttg | aaaaagcata | cattgtttgc | aaaacctcaa | agtagggctt |
| 2161 | gcttaaagga | aactgttgaa | tcttgtttga | aggacactgc | agtcctaacg | tgttcagtga |
| 2221 | aagcaaggtg | gtagatttct | ggacgtcata | catttacatt | taatataggt | aatattcatc |
| 2281 | agtgtaatgt | gacttcatgc | catatatatt | ttgtaaaaca | attccttttt | aaaaacttca |
| 2341 | agtatttctc | atttactcaa | atttgttgta | agtcctactt | aacagttagt | tactatgtgc |
| 2401 | tctgtggcct | tgttcagcat | tgtttgctgc | tttgggccaa | caattcaaga | actctaattt |
| 2461 | tcctgtgcat | taatcttttc | attttgcact | tttatgggtg | actgtcttag | tgtagcctct |
| 2521 | ggtaaaatac | tattaggtgg | cctggtttta | gagctcctcc | tcgctgcctt | ggcactcctt |
| 2581 | tgtgcaacac | gaccacttag | agatgacagc | tgtgagctgt | gctgcttttt | ctagccttta |
| 2641 | atttccaatg | tagtttataa | tgttgttctt | ctatagctcc | agctaaggtg | cctgttagtc |
| 2701 | ccctacaatg | ttatgagcat | tattgacatt | gaaaggttat | gtatgtatga | atacctttgc |
| 2761 | tccttaccag | acttgtcata | caaggactcg | tgcagtgtag | ccagtagagg | ctctttggtt |
| 2821 | ggcccaagaa | tgaggctgtt | ggtgtaagtg | aatcacaata | gggattggga | tagttcatgt |
| 2881 | catatgtcat | atagcaagac | aatgtagagt | gtaggcttgt | ctctctgcat | caacgctctg |
| 2941 | cctctttctt | tttatccttt | tagaacctac | atggacgcta | atctccacaa | cactgttgga |
| 3001 | tgtgaacact | cttaagacac | tcatctagtt | cactgtgcct | tgtccttagg | actcttaacc |
| 3061 | actttctagg | gagcagttat | ggcctgagat | ggacagtcat | ggcctgagaa | tgaagacact |
| 3121 | actttgataa | agaaaaaggc | ctcatttgcc | tatcagagtg | agaaaggttt | ttttctggtg |
| 3181 | ccttttgaaa | atatacagag | ccacttggtt | cttctgctga | aaatgtaatt | ttggtttgac |
| 3241 | tttttagagt | gcccttcctg | cctttatgag | gaaaacagct | attttttttt | ttgggggggg |
| 3301 | ggattccttt | tgttttctgt | gccattattt | attgcctttc | agagtgcaac | cattgggtgg |
| 3361 | ctttgctcct | tcagagaggg | ctccttgata | gccttcagta | gcttgagctg | tagacataag |
| 3421 | tattccatag | caagagtgtg | tcagctccat | gagagagatg | tctgctttat | agccgaggca |
| 3481 | gaaaccgttc | atgttccttt | acttggcagc | cttcaggaac | aggtttgtaa | gaacgtgtct |
| 3541 | tgagttgagt | gagtgtatgt | ctgtgagctc | tgctgaagtc | tggacacaag | ggccttgcct |
| 3601 | gctccttttt | tcagcagtgg | gttacatgtt | gtctctccac | agtcttcatg | tcataggtct |
| 3661 | cggacttgca | gagtcctatg | tggcctgcca | tctgtacagt | ggcaggactg | aagctctgag |
| 3721 | ctgttctgag | gttcatggag | aaatcccaac | ctattctgtg | gtcagtaaat | ggagactgtg |
| 3781 | tagtctacct | gctcctgtac | tgtccttact | gtatgtaagg | atatacagac | gcctgtgggt |
| 3841 | aggcagtact | cacagtgaga | tgaagacagc | aagtgtgcac | tgaaccacag | agggcaggga |
| 3901 | gtagggcctc | tgaagaagcc | accagaccag | accagtgccg | gtacagtctt | tgtcagagat |
| 3961 | ggctctgatg | gggcccagac | tgaccctgac | catgctgagt | tgctgagggt | agccttcagt |
| 4021 | tctctaccct | ctgaagtgct | aggatgacag | acatccgcca | tcatacccag | cttccgtggt |
| 4081 | gctaaggatc | agcctcagtc | ttcaggcgtg | ctaggcatgt | actttgccaa | gtatttagta |
| 4141 | tacaaaatac | attagtatct | gccagggaaa | aaagatttgc | aaataataaa | gattgccatc |
| 4201 | agtttgataa | atgttgtaaa | tggaagaatc | aaaatctcag | cgatggatta | cagcaacaag |
| 4261 | atgctgccta | ggaaaagcag | gaccaagagg | tacatttgac | tagtatacct | tcagcgtagc |
| 4321 | gtgatgacct | cactgatgtc | acccaactga | acttaagggc | tgtaagtagg | cgtgctgtgg |
| 4381 | gccttccaga | actagagaaa | attataggag | gaagtcagtt | ctaaagtatc | aaaagctggg |
| 4441 | taatggtggc | acatgccttt | gattctagca | ctcgggaagc | aggggctagc | ctagtctaca |
| 4501 | gagcaacttc | tacacagaga | aactgtcttg | gaggaaaata | aaaaaagaaa | agtcaaagag |
| 4561 | caaacaaata | gaacagagta | ggaatccgtg | tcccctttt | tctatgtttc | acggttgcag |
| 4621 | gtgtaagaaa | agtagtcata | gatgtggctg | agtttctaag | atgaaaccag | tagtaagatt |
| 4681 | gctaaatata | acacttcaac | caagttaaac | accctttggg | ggtatgaatg | aaagtaacac |
| 4741 | tgcaatatga | aatgaaccgt | gcaagtaaca | cttggggtta | cctcacagtc | tccctatgcc |
| 4801 | tgagaggact | gtgggaaaca | tttccatccc | ctgccagtat | cgccattggg | aggacagagt |
| 4861 | agatgaagaa | gtgaagtctt | actggtccag | ggcacgcctg | tcagcaatgc | catttgtgct |
| 4921 | tctgccacag | agagcaccga | gaggcttggc | tcagtatcct | cgaaccttct | ctggtcactt |
| 4981 | ccctggcagc | acttgggtcc | ctgtcactca | ctggtctctt | aaaagtcccg | tctctttgct |
| 5041 | tcctaaagat | tctctaaaaa | aattactatt | ttttatttct | tttttaaaag | tctttgttat |
| 5101 | tttgttttgg | gatacagtct | ctttgtacag | tcctggctgg | cctggaaatt | actatgtagg |
| 5161 | ccagcctcaa | acttgaagta | attctcttgc | ctctgcctct | ggagttctgg | gattacaggc |
| 5221 | atgcactgca | gagtacagtg | agctctgatg | gcttttaaaa | ttcagcccct | ttgagggttt |
| 5281 | ggttttagat | ccattagctt | tgtctgaacc | catctttgtc | cggccgagta | aatcctctgc |
| 5341 | tatccggggt | ctcggtagaa | atgtgttctc | agtatacata | cgactaaaca | ttggttgttt |
| 5401 | ataggtagcc | tcagatattt | ggtagagcat | ctttttttgaa | agtaatctcc | agctaggtgg |
| 5461 | gtatttccct | cacagcagta | ggattttccc | tttaggagat | accagttctt | catctttctt |
| 5521 | gtgaaaataa | tgcctttatg | gggagtgaag | attaaggagt | tgtttctaca | ctaacagaat |
| 5581 | tctatttgat | ggacaacttg | gacagttctg | tggacttggg | tgggttctag | tgtgctaaga |
| 5641 | aggataacag | tatttaatag | tgtctgtcat | caggccttgc | tcatctccct | gtctagggct |

TABLE 1-continued

```
5701 gtaggtcagt gctcgagcac ttagcaggca tcgagtctag tgttcagtgc ccagcattgc
5761 acagaactca gaatatatct gtactgaaac tgaagtgacc acctacaacc aggtggtatg
5821 ccagaaccac agaaaggaga ttcacggtga tgtgtttaaa gcattgggct ggtgacggtt
5881 gctgtgtagt aatgacctct tcctcagcaa agagagtcct ggagcaggct gtcctcagaa
5941 gagggaaggg actggtgtgc tccttgtgca gataacttag tgtataaatc ggcatgagta
6001 gctatccttt aaggatttgt ttgaagttac tctttgtaaa aagttgagaa ttttgtgtgc
6061 agttgggcac atgcttgccc ttcccccacc cgccatagtc ctgcctctct tgctgtgaac
6121 tggtgtcagc tacaacactc cagctaggtc tgagctcttt tgagagaagg tctcgtagag
6181 caccattctc agagagaagc taaagcatgg ggagccttag gacggtcagg caatgcactc
6241 tttaccacgg ctggctaagg ctgcagcttg accgtcctta cctaaatcag gtaagaatgt
6301 gattacagag cgagtgcttg tgttccccgg cctgccttct ccgaggaaga tgcttcatcc
6361 gaggatgatg cagagcagac gatggctgca ctgtaggtct gcctccttct gtgtatgggt
6421 tctgctgctg cttacggcat aggaaagtac actagcagcg tgcttcaatt ctgccatctt
6481 ttgatactta taaaaatgta ttaggtttta ctgtattgtg ctctcaaagc cataactctt
6541 aagaaatttg gttttttgc atattgtttg ctaatacttt gttttaataa acctcaaaat
6601 ctgcttac
```

SEQ ID NO: 170 Mouse SMAD5 amino acid sequence (NP_001157513.1; NP_001157514.1; NP_032567.1)

```
  1 mtsmaslfsf tspavkrllg wkqgdeeekw aekavdalvk klkkkkgame elekalsspg
 61 qpskcvtipr sldgrlqvsh rkglphviyc rvwrwpdlqs hhelkpldic efpfgskqke
121 vcinpyhykr vespvlppvl vprhnefnpq hsllvqfrnl shnephmpqn atfpdsfhqp
181 nnapfplspn spyppspass typnspassg pgspfqlpad tpppaymppd dqmapdnsqp
241 mdtssnmipq tmpsissrdv qpvayeepkh wcsivyyeln nrvgeafhas stsvlvdgft
301 dpsnnksrfc lgllsnvnrn stientrrhi gkgvhlyyvg gevyaeclsd ssifvqsrnc
361 nfhhgfhptt vckipsscsl kifnnqefaq llaqsvnhgf eavyeltkmc tirmsfvkgw
421 gaeyhrqdvt stpcwieihl hgplqwldkv ltqmgspinp issvs
```

SEQ ID NO: 171 Human SMAD9 transcript variant 1 cDNA sequence (NM_001127217.2; CDS: 344-1747)

```
   1 cgcactaata cgggcgatga ggcttcgcgg ctccagtctg actgacgccg gctggggccg
  61 ccgccgccgc cgccgccgcc gccgctgctg cagccgctgt ctcggtcccc gccgccgccg
 121 ccgggccctg caggcgctgg gcgcgcgcag ccaggcaagt tggccaccct gttcaagggc
 181 ttaggagaaa gtcaacacac ttcgcaactt gaattggtcc cagctgctcc cagaagaacg
 241 ggcgggttgg tccctatgcc accctggagg agctactcgc cgcccacttt gccgtgaagg
 301 gctgtgcggt tcccgtgcgc gccggagcct gctgtggcct cttatgcact ccaccacccc
 361 catcagctcc ctcttctcct tcaccagccc cgcagtgaag agactgctag gctggaagca
 421 aggagatgaa gaggaaaagt gggcagagaa ggcagtggac tctctagtga agaagttaaa
 481 gaagaagaag ggagccatgg acgagctgga gagggctctc agctgcccgg ggcagcccag
 541 caaatgcgtc acgattcccc gctccctgga cgggcggctg caggtgtccc accgcaaggg
 601 cctgccccat gtgatttact gtcgcgtgtg gcgctggccg gatctgcagt cccaccacga
 661 gctgaagccg ctggagtgct gtgagttccc atttggctcc aagcagaaag aagtgtgcat
 721 taacccttac cactaccgcc gggtggagac tccagtactg cctcctgtgc tcgtgccaag
 781 acacagtgaa tataaccccc agctcagcct cctggccaag ttccgcagcg cctccctgca
 841 cagtgagcca ctcatgccac acaacgccac ctatcctgac tctttccagc agcctccgtg
 901 ctctgcactc cctccctcac ccagccacgc gttctcccag tccccgtgca cggccagcta
 961 ccctcactcc ccaggaagtc cttctgagcc agagagtccc tatcaacact cagttgacac
1021 accacccctg ccttatcatg ccacagaagc ctctgagacc cagagtggcc aacctgtaga
1081 tgccacagct gatagacatg tagtgctatc gataccaaat ggagactttc gaccagtttg
1141 ttacgaggag ccccagcact ggtgctcggt cgcctactat gaactgaaca accgagttgg
1201 ggagacattc caggcttcct cccgaagtgt gctcatagat gggttcaccg acccttcaaa
1261 taacaggaac agattctgtc ttggacttct ttctaatgta aacagaaact caacgataga
1321 aaataccagg agacatatag gaaagggtgt gcacttgtac tacgtcgggg gagaggtgta
1381 tgccgagtgc gtgagtgaca gcagcatctt tgtgcagagc cggaactgca actatcaaca
1441 cggcttccac ccagctaccg tctgcaagat ccccagcggc tgcagcctca aggtcttcaa
1501 caaccagctc ttcgctcagc tcctggccca gtcagttcac cacggctttg aagtcgtgta
1561 tgaactgacc aagatgtgta ctatccggat gagttttgtt aagggttggg gtgctgagta
1621 tcatcgccag gatgtcacca gcacccctg ctggattgag attcatcttc atgggccact
1681 gcagtggctg gacaaagttc tgactcagat gggctctcca cataacccca tttcttcagt
1741 gtcttaacag tcatgtctta agctgcattt ccataggata gaggctattg cagggagtgg
1801 cttgtatcat ttcagatttg caactgaagt ttctaaaaac atgtgtaaat acatagaatg
1861 tatactgttc ttattttttt taatcaccgt ttgttttgtg ctttctagtt aacctgatgc
1921 cagtacagtg caattggaaa agcaggactt tggtgcctgt gctataagca gcagattttg
1981 tgggaggaaa cacttgagag gcgatattgt caacagtatt tgaagggtgt tagcagaata
2041 aaagacagct ttagtcagcc gtgtcattat aaagcatgtt gtgtggcctc acagaaacat
2101 tgaaactgtt tatacagcaa aagtcaggta ttagcagcac taaagcaaat atcactcaga
2161 tgaaacaaag cagtgaaacc cctacagttt aaatgatgtc acttttagtg ctgttggcaa
2221 gaaaaaaaaa acaacaaact tgtacaatga attaatgaga taggccatag aaactttatt
2281 tctaaggttg acatacctat agctgggctc ctgtgctcat attcagtggt acattttaaa
2341 caaactgtga tcggaaaaga aaaaaaactg tgaagccaaa agtcatgttc cctcagtcta
2401 ccactgtaaa aacagagtct aatatgggaa aataaaatatg aaaatagcat gaaatgctgt
2461 ttcccagatt gcaagataag accagaactt ggtccaagag ccagccaccc agggagactc
2521 ctgctttcca cagaggagac caggttcctg tcgtgctggt tgttcgtgtc aggcagtcct
2581 gcaaactttg agtctgcgca gcgtgccaga atagcttgtg tttcagtcct gtgtcaagaa
2641 gcaggtgaaa ccaaaggttg gagaaaagca tcacacgtcg acttacactt tctcatttcc
2701 cacgttccag tctcctggga agggcactct ttcgccacgt tttcctgcct cttggcaaat
2761 attaactctt tgcagatcac taaagcaaca gtaaagactt tgagaaaatc tagacacatt
2821 attggatcaa tgagttattt aacctagtgt ctagtgatta tctaacctgg aaataaattc
2881 ccaaggaaag tgataataat ttcataatca tctgcaattt ctggggaaca gtggtactga
2941 ataataagac atcttttaaa aatatacaca atattaaaaa cctgttctta ttttacttta
```

TABLE 1-continued

```
3001 gatgagggag gaaaatcccc caaatttcta ggtactttca tatatatact tgccatgcac
3061 taaacactgc attgcttgga aaaatatttc acaccctctt taaaaatgta caatttaaga
3121 tggcagttat gcttgtaaca gacagcactt cagtaatcca agaagtttct tcatttatac
3181 attttatctc aactctttct agcattagtg cacatggtag tttttctaat taaattgtat
3241 tcaaggtaga aatgatcatg tgagaaagat atatgattga gctactactg tcacctctta
3301 cagttactag tgttagctaa tagaaacttt catatataca catagaaaag aattattaca
3361 ttttacattg aaaaatgtaa tatatggccc atgtagtgta tagaaaaatc tgtagtttat
3421 tggttcatca actatgtatt gtgcacctac ctatgggtgt caggtacaat gttaggtact
3481 gtagaatcaa atgtaaataa gagacagtcc cagccctcag ggagccgaga acctaatagt
3541 gaatctgttt gtacagacat cttcatgttt cagaactttt aaaacaaaac aaaataatgt
3601 aatctatcat cttttgcttg aaagaatgtg attgatttct tatctctgtt ttgaaattat
3661 ttccttactc ttctgcaaag tcaggtaatg gattccttgt ataaatgcta cttttcttcc
3721 atgtctcaaa gttgtttttt ttcctcccct ttcttccctg ttttccaata attctccatg
3781 tccccttttc ttagaaaagg cattaatatg gtgaatcttg tatgggaacc attccatggg
3841 agaacttcaa cacagttttt gctccagaga tcaaacatag ctttcgtgat ctctctacca
3901 gctatctaac ttatcctctg gtaatctttt tttttttttt tttttttttg agatggagtc
3961 tcgctgtgtc accaggccag agtgcagtgg cgtgatcttg gctcactgca acctctgcct
4021 cccgggttcg agtgattctc ctgcctcagc ctcccaagta gttgggacta caggctacca
4081 cgcccagcta atttttatat ttttagtaga gacggggttt caccatggta gccagaatgg
4141 tctctatctc ttgaccttgt gatccgcccg cctcagcctc ccaaagtgct gggattacag
4201 gcgtgagcca ctgcgcccgg cttcctctgg taatcttaca cctttacaga attaatctaa
4261 actggtggct cataaatgac attaaaaaca aaaaaaaaat ctggatgcag tggctcattc
4321 ctatagtccc agcactttgg gaggccaagg cgggaggatc atctgagccc aggagtttgg
4381 ggctgtagtg aactatgatc atacaacttc attctagcct gggtgacaaa gtgacaccct
4441 gtctctaaac aaaaatcaag aaacaaaaaa cttgtatttc cctgcagctt tgggaagcca
4501 gaacacaata ttgcagtgaa tctgaatttt ctgtgacaaa taaattatta aattggcaca
4561 tatgatcatc accagtcatg tctcatcaaa agcctttatt atgatgcttg tacattttga
4621 agaatttaga attaatgaga agttaaccct ttagtcattg taacacaatc atattttaat
4681 cagctttttc ttttgctacc aagagtttca aaaaataaat gcagtatttg atttcaggct
4741 gctaaatggg ctcatttagc attcattcct tgatgtagac attaaaaaaa aaactgaata
4801 gcattctttc caggataact aataaagcag acatgctaag cctataaata catcagcact
4861 gcagcacacg tttaaggttg ccacggacaa ggatcacaca atagagaaca ctgtagtaac
4921 atttcggtct gctcacaaga cccagaacat tgatcagttt ttgttgttgg tttattattt
4981 ttctgttaaa aaattgtgaa aagtttgttt tagctagatg atattttaat agctgcgagt
5041 gctttggaac tataaagatg tcactactta acacatatac cttatgtttt gttttgtttt
5101 gttttacact cagtataaat caggagaagt tagccaacca tctagcattt agaatcctct
5161 tttttattgt cttctaagga tatggatgtt cccataacag caacaaaaca gcaacaaaaa
5221 catttcataa atatcacttg atagactgta agcacctgct taactttgtg tcccaaatat
5281 ttagtgtgta tatatatata tatatataca cacacacaca catatatatt caacaaataa
5341 agcaaaatat aacatgcatt tcacattttg tctttccctg ttacgatttt aatagcagaa
5401 ctgtatgaca agtttaggtg atcctagcat atgttaaatt caaattaatg taaaacagat
5461 taacaacaac aaagaaactg tctatttgag tgaagtcatg ctttctatta taataacttg
5521 gcttcggtta tccatcaaat gcacacttat actgttatct gattgtttat aataaagaat
5581 actgtactta ta
```

SEQ ID NO: 172 Human SMAD9 isoform 1 amino acid sequence (NP_001120689.1)

```
  1 mhsttpissl fsftspavkr llgwkqgdee ekwaekavds lvkklkkkkg amdelerals
 61 cpgqpskcvt iprsldgrlq vshrkglphv iycrvwrwpd lqshhelkpl eccefpfgsk
121 qkevcinpyh yrrvetpvlp pvlvprhsey npqlsllakf rsaslhsepl mphnatypds
181 fqqppcsalp pspshafsqs pctasyphsp gspsepespy qhsvdtpplp yhateasetq
241 sgqpvdatad rhvvlsipng dfrpvcyeep qhwcsvayye lnnrvgetfq assrsvlidg
301 ftdpsnnrnr fclgllsnvn rnstientrr higkgvhlyy vggevyaecv sdssifvqsr
361 ncnyqhgfhp atvckipsgc slkvfnnqlf aqllaqsvhh gfevvyeltk mctirmsfvk
421 gwgaeyhrqd vtstpcwiei hlhgplqwld kvltqmgsph npissvs
```

SEQ ID NO: 173 Human SMAD9 transcript variant 2 cDNA sequence (NM_005905.6; CDS: 310-1602)

```
   1 agtctgactg acgccggctg gggccgccgc cgccgccgcc gccgccgccg ctgctgcagc
  61 cgctgtctcg gtccccgccg ccgccgccgg gccctgcagg cgctgggcgc gcgcagccag
 121 gcaagttggc caccctgttc aagggcttag gagaaagtca acacacttcg caacttgaat
 181 tggtcccagc tgctcccaga agaacgggcg ggttggtccc tatgccaccc ctggagagct
 241 actcgccgcc cactttgccg tgaagggctg tgcggttccc gtgcgcgccg gagcctgctg
 301 tggcctctta tgcactccac cacccccatc agctccctct tctccttcac cagccccgca
 361 gtgaagagac tgctaggctg gaagcaagga gatgaagagg aaaagtgggc agagaaggca
 421 gtggactctc tagtgaagaa gttaaagaag aagaagggag ccatggacga gctggagagg
 481 gctctcagct gcccggggca gcccagcaaa tgcgtcacga ttccccgctc cctggacggg
 541 cggctgcagg tgtcccaccg caagggcctg ccccatgtga tttactgtcg cgtgtggcgc
 601 tggccggatc tgcagtccca ccacgagctg aagccgctgg agtgctgtga gttcccattt
 661 ggctccaagc agaaagaagt gtgcattaac ccttaccact accgccgggt ggagactcca
 721 gtactgcctc ctgtgctcgt gccaagacac agtgaatata acccccagct cagcctcctg
 781 gccaagttcc gcagcgcctc cctgcacagt gagccactca tgccacacaa cgccacctat
 841 cctgactctt tccagcagcc tccgtgctct gcactccctc cctcacccag ccacgcgttc
 901 tcccagtccc cgtgcacggc cagctaccct cactccccag gaagtccttc tgagccagag
 961 agtccctatc aacactcaga ctttcgacca gtttgttacg aggagcccca gcactggtgc
1021 tcggtcgcct actatgaact gaacaaccga gttggggaga cattccaggc ttcctcccga
1081 agtgtgctca tagatgggtt caccgaccct tcaaataaca ggaacagatt ctgtcttgga
1141 cttctttcta atgtaaacag aaactcaacg atagaaaata ccaggagaca tataggaaag
1201 ggtgtgcact tgtactacgt cgggggagag gtgtatgccg agtgcgtgag tgacagcagc
1261 atctttgtgc agagccggaa ctgcaactat caacacggct tccacccagc taccgtctgc
1321 aagatcccca gcggctgcag cctcaaggtc ttcaacaacc agctcttcgc tcagctcctg
```

TABLE 1-continued

```
1381 gcccagtcag ttcaccacgg ctttgaagtc gtgtatgaac tgaccaagat gtgtactatc
1441 cggatgagtt ttgttaaggg ttggggtgct gagtatcatc gccaggatgt caccagcacc
1501 ccctgctgga ttgagattca tcttcatggg ccactgcagt ggctggacaa agttctgact
1561 cagatgggct ctccacataa ccccatttct tcagtgtctt aacagtcatg tcttaagctg
1621 catttccata ggatagaggc tattgcaggg agtggcttgt atcatttcag atttgcaact
1681 gaagtttcta aaaacatgtg taaatacata gaatgtatac tgttcttatt ttttttaatc
1741 accgtttgtt ttgtgctttc tagttaacct gatgccagta cagtgcaatt ggaaaagcag
1801 gactttggtg cctgtgctat aagcagcaga ttttgtggga ggaaacactt gagaggcgat
1861 attgtcaaca gtatttgaag ggtgttagca gaataaaaga cagctttagt cagccgtgtc
1921 attataaagc atgttgtgtg gcctcacaga aacattgaaa ctgtttatac agcaaaagtc
1981 aggtattagc agcactaaag caaatatcac tcagatgaaa caaagcagtg aaacccctac
2041 agtttaaatg atgtcacttt tagtgctgtt ggcaagaaaa aaaaaacaac aaacttgtac
2101 aatgaattaa tgagataggc catagaaact ttatttctaa ggttgacata cctatagctg
2161 ggctcctgtg ctcatattca gtggtacatt ttaaacaaac tgtgatcgga aaagaaaaaa
2221 aactgtgaag ccaaaagtca tgttccctca gtctaccact gtaaaaacag agtctaatat
2281 gggaaaataa atatgaaaat agcatgaaat gctgtttccc agattgcaag ataagaccag
2341 aacttggtcc aagagccagc cacccaggga gactcctgct ttccacagag gagaccaggt
2401 tcctgtcgtg ctggttgttc gtgtcaggca gtcctgcaaa ctttgagtct gcgcagcgtg
2461 ccagaatagc ttgtgtttca gtcctgtgtc aagaagcagg tgaaaccaaa ggttggagaa
2521 aagcatcaca cgtcgactta cactttctca tttcccacgt tccagtctcc tgggaagggc
2581 actctttcgc cacgtttcc tgcctcttgg caaatattaa ctctttgcag atcactaaag
2641 caacagtaaa gactttgaga aaatctagac acattattgg atcaatgagt tatttaacct
2701 agtgtctagt gattatctaa cctggaaata aattcccaag gaaagtgata ataatttcat
2761 aatcatctgc aatttctggg gaacagtggt actgaataat aagacatctt ttaaaaatat
2821 acacaatatt aaaaacctgt tcttatttta ctttagatga gggaggaaaa tcccccaaat
2881 ttctaggtac tttcatatat atacttgcca tgcactaaac actgcattgc ttggaaaaat
2941 atttcacacc ctctttaaaa atgtacaatt taagatggca gttatgcttg taacagacag
3001 cacttcagta atccaagaag tttcttcatt tatacatttt atctcaactc tttctagcat
3061 tagtgcacat ggtagttttt ctaattaaat tgtattcaag gtagaaatga tcatgtgaga
3121 aagatatatg attgagctac tactgtcacc tcttacagtt actagtgtta gctaatagaa
3181 actttcatat atacacatag aaaagaatta ttacatttta cattgaaaaa tgtaatatat
3241 ggcccatgta gtgtatagaa aaatctgtag tttattggtt catcaactat gtattgtgca
3301 cctacctatg ggtgtcaggt acaatgttag gtactgtaga atcaaatgta aataagagac
3361 agtcccagcc ctcagggagc cgagaaccta atagtgaatc tgtttgtaca gacatcttca
3421 tgtttcagaa cttttaaaac aaaacaaaat aatgtaatct atcatctttt gcttgaaaga
3481 atgtgattga tttcttatct ctgttttgaa attatttcct tactcttctg caaagtcagg
3541 taatggattc cttgtataaa tgctactttt cttccatgtc tcaaagttgt tttttttcct
3601 ccccttcctt ccctgttttc caataattct ccatgtcccc ttttcttaga aaaggcatta
3661 atatggtgaa tcttgtatgg gaaccattcc atgggagaac ttcaacacag tttttgctcc
3721 agagatcaaa catagctttc gtgatctctc taccagctat ctaacttatc ctctggtaat
3781 cttttttttt ttttttttt ttttgagatg gagtctcgct gtgtcaccag gccagagtgc
3841 agtggcgtga tcttggctca ctgcaacctc tgcctcccgg gttcgagtga ttctcctgcc
3901 tcagcctccc aagtagttgg gactacaggc taccacgccc agctaatttt tatattttta
3961 gtagagacgg ggtttcacca tggtagccag aatggtctct atctcttgac cttgtgatcc
4021 gcccgcctca gcctcccaaa gtgctgggat tacaggcgtg agccactgcg cccggcttcc
4081 tctggtaatc ttacaccttt acagaattaa tctaaactgg tggctcataa atgacattaa
4141 aaacaaaaaa aaaatctgga tgcagtggct cattcctata gtcccagcac tttgggaggc
4201 caaggcggga ggatcatctg agcccaggag tttggggctg tagtgaacta tgatcataca
4261 acttcattct agcctgggtg acaaagtgac accctgtctc taaacaaaaa tcaagaaaca
4321 aaaaacttgt atttccctgc agctttggga agccagaaca caatattgca gtgaatctga
4381 attttctgtg acaaataaat tattaaattg gcacatatga tcatcaccag tcatgtctca
4441 tcaaaagcct ttattatgat gcttgtacat tttgaagaat ttagaattaa tgagaagtta
4501 accctttagt cattgtaaca caatcatatt ttaatcagct ttttcttttg ctaccaagag
4561 tttcaaaaaa taaatgcagt atttgatttc aggctgctaa atgggctcat ttagcattca
4621 ttccttgatg tagacattaa aaaaaaaact gaatagcatt ctttccagga taactaataa
4681 agcagacatg ctaagcctat aaatacatca gcactgcagc acacgtttaa ggttgccacg
4741 gacaaggatc acacaataga gaacactgta gtaacatttc ggtctgctca caagacccag
4801 aacattgatc agtttttgtt gttggtttat tatttttctg ttaaaaaatt gtgaaaagtt
4861 tgttttagct agatgatatt ttaatagctg cgagtgcttt ggaactataa agatgtcact
4921 acttaacaca tataccttat gttttgtttt gttttgtttt acactcagta taaatcagga
4981 gaagttagcc aaccatctag catttagaat cctctttttt attgtcttct aaggatatgg
5041 atgttcccat aacagcaaca aaacagcaac aaaaacattt cataaatatc acttgataga
5101 ctgtaagcac ctgcttaact ttgtgtccca aatatttagt gtgtatatat atatatatat
5161 atacacacac acacacatat atattcaaca aataaagcaa aatataacat gcatttcaca
5221 ttttgtcttt ccctgttacg attttaatag cagaactgta tgacaagttt aggtgatcct
5281 agcatatgtt aaattcaaat taatgtaaaa cagattaaca acaacaaaga aactgtctat
5341 ttgagtgaag tcatgctttc tattataata acttggcttc ggttatccat caaatgcaca
5401 cttatactgt tatctgattg tttataataa agaatactgt acttata
```

SEQ ID NO: 174 Human SMAD9 isoform 2 amino acid sequence (NP_005896.1)

```
  1 mhsttpissl fsftspavkr llgwkqgdee ekwaekavds lvkklkkkkg amdelerals
 61 cpgqpskcvt iprsldgrlq vshrkglphv iycrvwrwpd lqshhelkpl eccefpfgsk
121 qkevcinpyh yrrvetpvlp pvlvprhsey npqlsllakf rsaslhsepl mphnatypds
181 fqqppcsalp pspshafsqs pctasyphsp gspsepespy qhsdfrpvcy eepqhwcsva
241 yyelnnrvge tfqassrsvl idgftdpsnn rnrfclglls nvnrnstien trrhigkgvh
301 lyyvggevya ecvsdssifv qsrncnyqhg fhpatvckip sgcslkvfnn qlfaqllaqs
361 vhhgfevvye ltkmctirms fvkgwgaeyh rqdvtstpcw ieihlhgplq wldkvltqmg
421 sphnpissvs
```

TABLE 1-continued

SEQ ID NO: 175 Mouse SMAD9 cDNA sequence (NM_019483.5; CDS: 320-1612)

```
   1 agcctgactg acgcctctgg agccgctgtc tcggtcccgc cgccgcccgg ccgaccctgc
  61 agctaccgcg caaccggagt gcgcgggggg cacgcgtggc acctctcgga cagagtaagc
 121 tggctccact ttccaagagc tttggaagac gtcagcccat ctcccagttt gaatcggacc
 181 ccactgcttc cagaaggaaa ggcaagcttg ttcctatgac atccgtggac aggtacttgc
 241 cgccgactg cccggggccc tgcaagcctt gaaaggtctc atcctctttc cccgtgcagc
 301 agcctgagct ctgcctccta tgcaccccag cacccccatc agctccctct tctccttcac
 361 cagccccgca gtgaagcggc tgctgggctg gaagcaggga gatgaagagg agaagtgggc
 421 agagaaggcg gtggactctt tggtgaagaa gttaaagaag aagaaaggcg ccatggatga
 481 actggagagg gcgctgagct gcccgggtca gcctagcaag tgtgtcacca tcccacggtc
 541 cctcgatgga cgcctccagg tgtcccaccg aaaggggctg ccccacgtca tctactgccg
 601 cgtgtggcgc tggccagacc tgcagtccca tcatgagctg aagcccttgg agtgctgtga
 661 gttcccgttc ggctccaagc agaaggaggt ctgcatcaac ccataccatt accgcagagt
 721 ggagaccccca gttctgcctc cagtgctggt accaagacac agcgagtaca accctcagct
 781 cagcctcctg gccaagttcc gaagtgcctc gctgcacagc gaacccctca tgccgcacaa
 841 cgccacctac cctgactctt tccagcagtc tctctgtccg gcaccgccct cctcgccagg
 901 ccatgtgttt ccgcagtctc catgccccac cagctacccg cactcccccg gaagtccttc
 961 cgagtcagac agtccctatc aacactcaga cttccggcca gtttgctacg aggaacccca
1021 gcactggtgt tctgttgcct actacgaact aaacaaccgg gtcggagaga ctttccaggc
1081 gtcctcgcgg agcgtgctca tagacggctt caccgaccct tccaataaca ggaataggtt
1141 ctgccttggg cttctctcaa atgtaaacag aaactcgacc atagaaaaca ccaggaggca
1201 cattggaaag ggtgtgcatt tgtactacgt tgggggcgag gtgtatgcgg agtgcgtgag
1261 cgacagcagc atctttgtcc agagccggaa ctgcaactac cagcacggct tccacccggc
1321 caccgtctgc aagatcccca gcggctgcag cctcaaggtc ttcaacaacc agctcttcgc
1381 ccagctgctc gcccagtccg tgcaccacgg ctttgaagtg gtgtatgagc tgacgaagat
1441 gtgcacgatt cggatgagct ttgtgaaggg ctggggagca gagtatcatc gccaggatgt
1501 cacgagcacc ccctgctgga tcgagatcca tcttcatgga ccgctgcagt ggttggataa
1561 ggtgctcact cagatgggct ccccacacaa ccctatctct tcagtgtctt aagtcacgtc
1621 gtcagccacg ttgccacaga acagactcgg gcaggggctt ccatcgtggc aaccgcagct
1681 aatgcagggt tccggatgca gatgtaaata cacgtgtaac gcatccgagt cacgtttata
1741 tcaccgtttg ttttgtgcta cctacttaac ctggggccag tgcggtgtgg tcgaagaagc
1801 gtggtttctc tctgatggga gccaagtctt ctgtgagagg gaaacagcac gtgagggcgt
1861 cggcaggact caaggccacc gagtcagctc atcgtcactc cacaggaggt tgtgccccac
1921 atggaaaaca caaagctgct tacacagaag gaataggagc actagagcaa aatcagtcac
1981 acacaagtgg ttttaaaaag acctcacttg caatgtgagt gtcaagaaag aaaaccaagc
2041 ttgtccaggg acctgtgaga taaagccaca gaaactttat ctccgaagct gaaatacaca
2101 tagccaggta ctgtgctgac ggcaggtaca ttcaaccaga tctaaactgt gattggagag
2161 ggagaaactg tgaagcttgg agtcagtggc ctcaatctaa aacaagcaag caggcaggca
2221 ggcaggcggg cgggcgggcg ggcaggcggg tgggcaggca ggcaagcaaa gccaaggctc
2281 ttaagggaaa ccggcctgag aggaggcttg atccagggtt agcccagaat tcaggcccgg
2341 aagcacaggg aactcctgcg tccactctgg aagccatctt cccgtcttcc cgtccctcct
2401 gtctgacctt gcagatggct gcctgccctg tgcacactac aaaccccgtg cagagatgaa
2461 gctgtagact ggaaggttgg gagggaagtg caggctaggc agggcatccc ttgcctcatt
2521 tttcctcctg gtgacaaata gcaattagtg acagatgatt caaacaagag caaagccttg
2581 ggaaagctcg aggcatcttt ggatcttatt tatgcatctc tcagcctggc acctatgtta
2641 agttattagc tggttacatc agtgcagcct cttctaaagc tattaaatac ctggatatag
2701 cttcccaggt gaagtaggaa tgtttcatat gccctacatt tttttatttt tatgaggaaa
2761 cagtggtagt gaataataaa gcatctttaa aaaacacctt atgtgtatat agacatgcat
2821 atatcagctc attccctctg ttggatgata agggaaatat cctccagact tcaaggtaca
2881 tgccactcat taggcacccc attgcttcta agtttacttc aagccctttg aaaaggatta
2941 tgtaggatgg catttattgt ttaaaggata gagcttccat aatatgatag agatattata
3001 tcggaaactc atttcgtctc aaactaccac ttagagtgta taagaaaaaa aacccaagca
3061 tgtcgattca ttaagtctgt cttgtgcatt tgtgtgtact gggtacagtg tcaggtacca
3121 gggaatcaaa cgcacattag aggcagtccc cacctccata acgccagaca tctaacggta
3181 aaccatttgc acagacatca ggtctcagaa ctttaaaaac ccccacacatg tgaatcttct
3241 tgggctcgaa aaataacata atcgagttct gaacaatagt taagaactct attgtaataa
3301 ctatattggg attttatgtc tcctcagaac acttgagtaa tttatctttt cataactact
3361 tccattccta gccaccccac ctcctggaat ccctattttt ttctgatatt tctcctggtt
3421 tcttccttgg aaaagccatg tgtacccatc taaggacaca aagcattgtc ccagatttcc
3481 caccgcccct ttgatctcct cacaagtggc caaatatccc tggcaatctg tagttgtaag
3541 aaactattca ggagtaggag cttcagggtg tagtggtacc gtggtacctg cctttgatct
3601 cagcagcagg gagacagagg caggtggatc cctgtgaatt caggcctgac ctggtctata
3661 taaggagtta caggacagcc agggctatac actgaaaccc tgtctcaaaa caaaagtaga
3721 agcttaaaaa caaaactaaa aaccaaacaa acaagtaaac tacttggact tccttgcagt
3781 gttaagaaat caaaatattg aagcgtgtct gatttctttg agaaaggaat catgacctag
3841 gttcatatgt atattatcag agaatttagc tttgaagaga tataagtcct atgcttgtat
3901 agcagagtca cattttaatg aattttcccc ctttggctgt taagagatct aaacgtatca
3961 taacgtaatc cttgacttca actcctctga gtgaccatgt ggcgatcatt ccatgaagct
4021 gacaagcaaa cttatgctgc gtaggttgtt ttacagggtg aaggggaaag tgggcagcca
4081 ggcctttgca cactgcaagt tgcctcaggc agggtcaggc aatggagatc tgtatcggtt
4141 tggcttgccc acaagaccca gaatgtttat cactgtgtac aagtcagtat gtgtgagtct
4201 tagcaaaaat aagacatgat cagtttgttt cagctaagtg attacaactg tttcagaact
4261 aagaagacac caccttgtta acatacacac ttcggtgttg tgttgtagag tcagcaaaac
4321 tctctagcat ttagaatatt cttttcattg tgttctaagg gtggagttat cctcataacg
4381 acaacagaaa gaagagtagc aaaatcattt tataaaaatc gcttgctgga ctttaagctc
4441 ctgcttaatg ctgagtatgt tccagatatt tcatgtatgt atttaataaa gtaaaatata
4501 ccatgcattc cacatcgtct tacctgctag agtcaagagc cgaactttgc aagggtaggt
4561 aaccctcaca tatgttcata ataagttctt tttttggggg gagagggagg ttcaagacag
4621 ggtttctctg tatagccctg gctgtcctgg aactcgcttt gtagaacagg ctggcctcaa
4681 actcagaaat ctgcttgcct ctgcctcccg agtgctggga ttaaaggcgt gcaccaccac
```

TABLE 1-continued 4741 gtccggctct catgataaat tcgaatgtat ataaaacaga cagccaagat tactctttga
4801 ttcccagaag ccttgccttc ctgaaatgcc acacaccaca ctttggtagt ctgtgctaga
4861 caatgataca ccttttggct tatttttctt tcaaactcta ggaaatactt ctatgtatat
4921 gatctatggc tccttaagat gcttaatcat aaactgttct acttagaaaa tgagcttttt
4981 aagaagtctt catgctgtaa aaactttggt ggcactataa caaaaaagac atcttcgaat
5041 atttggcatt aatgtgtaat tttaatgata ctttgcagaa tttttagagg tgtttaacta
5101 ctgctcccca gcttagcacc aggacacaca actcaaaccc tttgtatggt aaagctgttg
5161 ttattaaaaa gtgaatttaa tacacactgt cgtttgagca tcctacctta gcaactcaac
5221 agccacgtcc atcaaggaac atgtctatag gaagatgttt agcatgtgat gcttaaaaca
5281 cctggatata taggggaact ttcactaaaa actcatttat ttttcatatg ccatgaaata
5341 tgtttaactg attaaaatgt tttctaagag aagcttgtga SEQ ID NO: 176 Mouse SMAD9 amino acid sequence (NP_062356.3)
1 mhpstpissl fsftspavkr llgwkqgdee ekwaekavds lvkklkkkkg amdelerals
61 cpgqpskcvt iprsldgrlq vshrkglphv iycrvwrwpd lqshhelkpl eccefpfgsk
121 qkevcinpyh yrrvetpvlp pvlvprhsey npqlsllakf rsaslhsepl mphnatypds
181 fqqslcpapp sspghvfpqs pcptsyphsp gspsesdspy qhsdfrpvcy eepqhwcsva
241 yyelnnrvge tfqassrsvl idgftdpsnn rnrfclglls nvnrnstien trrhigkgvh
301 lyyvggevya ecvsdssifv qsrncnyqhg fhpatvckip sgcslkvfnn qlfaqllaqs
361 vhhgfevvye ltkmctirms fvkgwgaeyh rqdvtstpcw ieihlhgplq wldkvltqmg
421 sphnpissvs Included in Table 1 are nucleic acid molecules comprising a nucleic acid sequence having at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% or more identity to the region encoding the DNA binding domain or across their full length with a nucleic acid sequence of any SEQ ID NO listed in Table 1. Such nucleic acid molecules can encode a polypeptide having a function of the full-length polypeptide as described further herein.

Included in Table 1 are polypeptide molecules comprising an amino acid sequence having at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity to the DNA binding domain or across their full length with an amino acid sequence of any SEQ ID NO listed in Table 1. Such polypeptides can have a function of the full-length polypeptide as described further herein.

TABLE 2

Smad6
Smad7

SEQ ID NO: 177 Human Smad6 cDNA sequence (NM_005585.5; CDS: 1024-2514)
1 atatgatggg aggcagccaa tgactccgcg gcgctcctcc gggggccctc agtgtgcgtt
61 tgaggagaac aaaaaagaga gagagagccg agcgggggag cgatcgaggg agctgagccg
121 agagaaagag ccgccgggcg ctgcctcgcc agacctcgct gggaccccgg ggccaccggg
181 aggcactttt gtggaggggg gagggggggc gacctcggca gcctcggcgc acgaagcgtc
241 cgagggcagc gtggggcggg ctgcgacctc tgcatcggtg gactgcattt ttaattaagg
301 attcccagca gctctttggg atttttacag cttccactca tgtgttgaca cccgcgtcca
361 ggagaaactc gctccaagtg catctagcgc ctgggacctg agacggcgtt ggcctttcgt
421 gcatgcaaat ccagggattt aggttttgtt tgggatttcc ttttctttct ttcctttttt
481 ttttcttttt gcagggagta agaagggagc tgggggtatc aacaagcctg cctttcggat
541 cctgcgggaa aagcccatgt agttaagcgc tttggtttaa aaaaaaggca aggtaaaggc
601 agggctttcc agacacattt aggggttcgc gcgagcgctt tgtgctcatg gaccagccgc
661 acaacttttg aaggctcgcc ggcccatgtg gggtctttct ggcggcgcgc cgcctgcagc
721 ccccctaaag cgcgggggct ggagttgttg agcagccccg ccgctgtggt ccatgtagcc
781 gctggccgcg cgcggactgc ggctcggcgt gcgcgtgttc ccggccgtcc cgcctcggcg
841 agctccctca tgttgtcgcc ctgcggcgcc ccttcgacga caggctgtgc gcggtctgca
901 cggcgctccg cggcggagct tcatgtgggg ctgcgacccg cgcagccggc gcctcgctga
961 gggaacggac ccccggtaac cggagaccgc ctcccccca cccctggcgc caaaggatat
1021 cgtatgttca ggtccaaacg ctcggggctg gtgcggcgac tttggcgaag tcgtgtggtc
1081 cccgaccggg aggaaggcgg cagcggcggc ggcggtggcg gcgacgagga tgggagcttg TABLE 2-continued

| | | | | | | |
|---|---|---|---|---|---|---|
| 1141 | ggcagccgag | ctgagccggc | cccgcgggca | agagagggcg | gaggctgcgg | ccgctccgaa |
| 1201 | gtccgcccgg | tagccccgcg | gcggccccgg | gacgcagtgg | gacagcgagg | cgcccagggc |
| 1261 | gcggggaggc | gccggcgcgc | agggggcccc | ccgaggccca | tgtcggagcc | aggggccggc |
| 1321 | gctgggagct | ccctgctgga | cgtggcggag | ccgggaggcc | cgggctggct | gcccgagagt |
| 1381 | gactgcgaga | cggtgacctg | ctgtctcttt | tcggagcggg | acgccgccgg | cgcgccccgg |
| 1441 | gacgccagcg | acccccctggc | cggggcggcc | ctggagccgg | cgggcggcgg | gcggagtcgc |
| 1501 | gaagcgcgct | cgcggctgct | gctgctggag | caggaactca | aaaccgtcac | gtactcgctg |
| 1561 | ctgaagcggc | tcaaggagcg | ctcgctggac | acgctgctgg | aggcggtgga | gtcccgcggc |
| 1621 | ggcgtgccgg | gcggctgcgt | gctggtgccg | cgcgccgacc | tccgcctggg | cggccagccc |
| 1681 | gcgccgccgc | agctgctgct | cggccgcctc | tttcgctggc | ccgacctgca | gcacgccgtg |
| 1741 | gagctgaagc | ccctgtgcgg | ctgccacagc | ttcgccgccg | ccgccgacgg | ccctaccgtg |
| 1801 | tgctgcaacc | cctaccactt | cagccggctc | tgcgggcccg | aatctccgcc | acctccctac |
| 1861 | tctcggctgt | ctcctcgcga | cgagtacaag | ccactggatc | tgtccgattc | cacattgtct |
| 1921 | tacactgaaa | cggaggctac | caactccctc | atcactgctc | cgggtgaatt | ctcagacgcc |
| 1981 | agcatgtctc | cggacgccac | caagccgagc | cactggtgca | gcgtggcgta | ctgggagcac |
| 2041 | cggacgcgcg | tgggccgcct | ctatgcggtg | tacgaccagg | ccgtcagcat | cttctacgac |
| 2101 | ctacctcagg | gcagcggctt | ctgcctgggc | cagctcaacc | tggagcagcg | cagcgagtcg |
| 2161 | gtgcggcgaa | cgcgcagcaa | gatcggcttc | ggcatcctgc | tcagcaagga | gcccgacggc |
| 2221 | gtgtgggcct | acaaccgcgg | cgagcacccc | atcttcgtca | actccccgac | gctggacgcg |
| 2281 | cccggcggcc | gcgccctggt | cgtgcgcaag | gtgccccccg | gctactccat | caaggtgttc |
| 2341 | gacttcgagc | gctcgggcct | gcagcacgcg | cccgagcccg | acgccgccga | cggcccctac |
| 2401 | gaccccaaca | gcgtccgcat | cagcttcgcc | aagggctggg | ggccctgcta | ctcccggcag |
| 2461 | ttcatcacct | cctgccccctg | ctggctggag | atcctcctca | acaaccccag | atagtggcgg |
| 2521 | ccccggcggg | aggggcgggt | gggaggccgc | ggccaccgcc | acctgccggc | ctcgagaggg |
| 2581 | gccgatgccc | agagacacag | cccccacgga | caaaaccccc | cagatatcat | ctacctagat |
| 2641 | ttaatataaa | gttttatata | ttatatggaa | atatatatta | tacttgtaat | tatggagtca |
| 2701 | tttttacaat | gtaattattt | atgtatggtg | caatgtgtgt | atatggacaa | aacaagaaag |
| 2761 | acgcactttg | gcttataatt | ctttcaatac | agatatattt | tctttctctt | cctccttcct |
| 2821 | cttccttact | ttttatatat | atatataaag | aaaatgatac | agcagagcta | ggtggaaaag |
| 2881 | cctgggtttg | gtgtatggtt | tttgagatat | taatgcccag | acaaaaagct | aataccagtc |
| 2941 | actcgataat | aaagtattcg | cattatagtt | ttttttaaac | tgtcttcttt | ttacaaagag |
| 3001 | gggcaggtag | ggcttcagcg | gatttctgac | ccatcatgta | ccttgaaact | tgacctcagt |
| 3061 | tttcaagttt | tacttttatt | ggataaagac | agaacaaatt | gaaaagggag | gaaagtcaca |
| 3121 | tttactctta | agtaaaccag | agaaagttct | gttgttcctt | cctgcccatg | gctatggggt |
| 3181 | gtccagtgga | tagggatggc | ggtggggaaa | agaatacact | ggccatttat | cctggacaag |
| 3241 | ctcttccagt | ctgatggagg | aggttcatgc | cctagcctag | aaaggcccag | gtccatgccc |
| 3301 | cccatctttg | agttatgagc | aagctaaaag | aagacactat | ttctcaccat | tttgtggaaa |
| 3361 | tggcctgggg | aacaaagact | gaaatgggcc | ttgagcccac | ctgctacctt | gcagagaacc |
| 3421 | atctcgagcc | ccgtagatct | ttttaggacc | tccacaggct | atttcccacc | ccccagccaa |
| 3481 | aaatagctca | gaatctgccc | atccagggct | gtattaatga | tttatgtaaa | ggcagatggt |

TABLE 2-continued

```
3541  ttatttctac tttgtgaaag ggaaaagttg aggttctgga aggttaaatg atttgctcat
3601  gagacaaaat caaggttaga agttacatgg aattgtagga ccagagccat atcattagat
3661  cagctttctg aagaatattc tcaaaaaaag aaagtctcct tggccagata actaagagga
3721  atgtttcatt gtatatcttt tttcttggag atttatatta acatattaag tgctctgaga
3781  agtcctgtgt attatctctt gctgcataat aaattatccc caaactta
```

SEQ ID NO: 178 Human Smad6 amino acid sequence (NP_005576.3)

```
  1  mfrskrsglv rrlwrsrvvp dreeggsggg gggdedgslg sraepaprar egggcgrsev
 61  rpvaprrprd avgqrgaqga grrrraggpp rpmsepgaga gsslldvaep ggpgwlpesd
121  cetvtcclfs erdaagaprd asdplagaal epagggrsre arsrllllеq elktvtysll
181  krlkersldt lleavesrgg vpggcvlvpr adlrlggqpa ppqlllgrlf rwpdlqhave
241  lkplcgchsf aaaadgptvc cnpyhfsrlc gpesppppys rlsprdeykp ldlsdstlsy
301  teteatnsli tapgefsdas mspdatkpsh wcsvaywehr trvgrlyavy dqavsifydl
361  pqgsgfclgq lnleqrsesv rrtrskigfg illskepdgv waynrgehpi fvnsptldap
421  ggralvvrkv ppgysikvfd fersglqhap epdaadgpyd pnsvrisfak gwgpcysrqf
481  itscpcwlei llnnpr
```

SEQ ID NO: 179 Mouse Smad6 cDNA sequence (NM_008542.3; CDS: 1036-2523)

```
   1  agactggcat atgatgggag gcagccaatg actccgcggc gctcctccgg gggccctcag
  61  tgtgcgtttg aggagaacaa aaaagagaga gagcgccgag agggggaacg agcgagggag
 121  ctgagtccag agaaagagcc gccgggcgct gcctcgccaa acctcgctgg gaccgcgggg
 181  ccaccaggag gcactttggt gaaggggggg gggggcgacc tcggcagccg cggcgcccga
 241  agcgacccag cgcagcgtgg ggcgggctgc gacctctgct tcggtggatt gcatttttaa
 301  ttaaggattc ctagcagctc tttgggattt ttttttccg gcttccactc atgtgttgac
 361  acccgcgttc aggagagact tgccccaagt gcaccgagcg cccgggacct gagacggaat
 421  tgcttttcgt gcgtgcaaaa tccaagcatt ttgagttttg tttgggacct ttttcttgct
 481  ttgcttttat ttctattttt attttgttgc agggatatgg gagttatcca caagccttag
 541  tttcggatcc tgcagggaaa gcccatgtag catagcttgg cttttgaagg cagagttgtg
 601  cagacacatt tgggggcacg acgcaagcgc tttgtgctcg tgtaccagcc gcgcaacttt
 661  tgaaggctcg ccggcccatg cagggtgtct ctagcatcgt ttcgctggtg gcttccctaa
 721  ggctccaaag cagctggagt tgagcggtcc cggcccatcg tgatccatgt agcccgctgg
 781  tccctcgcgg actgaggctc aacacgcgcg tgttcccggc ccggcccggc ccggcttggc
 841  ccggcgcgag ctccctcatg ttgcagccct gcggtgcccc ttcgacgaca ggctgtgcgc
 901  ggtctgcacg gcgccccgcg gcagagcttc atgtggggct gcggcccgct cagccggcgc
 961  ctcgttgagg gaacggaccc ccggtaaccg gagaccgcct cccctcccac caccccaggc
1021  gccaaagggt atcgtatgtt caggtctaaa cgttcggggc tggtgcggcg actttggcga
1081  agtcgtgtgg tccctgatcg ggaggaaggc agcggcggcg gcggtggtgt cgacgaggat
1141  gggagcctgg gcagccgagc tgagcctgcc ccgcgggcac gagagggcgg aggctgcagc
1201  cgctccgaag tccgctcggt agccccgcgg cggccccggg acgcggtggg accgcgaggc
1261  gccgcgatcg cgggcaggcg ccggcgcaca gggggcctcc cgaggcccgt gtcggagtcg
1321  ggggccgggg ctgggggctc cccgctggat gtggcggagc ctggaggccc aggctggctg
1381  cctgagagtg actgcgagac ggtgacctgc tgtctcttct ccgaacggga cgcagcaggc
1441  gcgccccggg actctggcga tccccaagcc agacagtccc cggagccgga ggagggcggc
```

TABLE 2-continued

```
1501  gggcctcgga gtcgcgaagc ccgctcgcga ctgctgcttc tggagcagga gctcaagacg
1561  gtcacgtact cgctgctcaa gaggctcaag gagcgttcgc tggacacgct gttggaggct
1621  gtggagtccc gaggcggcgt accgggcggc tgcgtgctgg tgccgcgcgc cgacctccgc
1681  ttgggcggcc agcccgcgcc accgcagctg ctgctcggcc gcctcttccg ctggccagac
1741  ctgcagcacg cagtggagct gaaacccctg tgcggctgcc acagctttac cgccgccgcc
1801  gacgggccca cggtgtgttg caacccctac cacttcagcc ggctctgcgg gccagaatca
1861  ccgccgcccc cctattctcg gctgtctcct cctgaccagt acaagccact ggatctgtcc
1921  gattctacat tgtcttacac tgaaaccgag gccaccaact ccctcatcac tgctccgggt
1981  gaattctcag atgccagcat gtctccggat gccaccaagc cgagccactg gtgcagcgtg
2041  gcgtactggg agcaccggac acgcgtgggc cgcctctatg cggtgtacga ccaggctgtc
2101  agcatttct acgacctacc tcagggcagc ggcttctgcc tgggccagct caacctggag
2161  cagcgcagtg agtcggtgcg gcgcacgcgc agcaagatcg gttttggcat actgctcagc
2221  aaggagccag acggcgtgtg ggcctacaac cggggcgagc accccatctt cgtcaactcc
2281  ccgacgctgg atgcgcccgg aggccgcgcc ctggtcgtgc gcaaggtgcc accgggttac
2341  tccatcaagg tgttcgactt tgagcgctca gggctgctgc agcacgcaga cgccgctcac
2401  ggcccctacg acccgcacag tgtgcgcatc agcttcgcca agggctgggg accctgctac
2461  tcgcgacagt tcatcacctc ctgcccctgt tggctggaga tcctactcaa caaccacaga
2521  tagcaatgcg gctgccactg tgccgcagcg tcccccaacc tctggggggc cagcgcccag
2581  agacaccacc ccagggacaa cctcgccctc cccccagata tcatctacct agatttaata
2641  taaagtttta tatattatat ggaaatatat attatacttg taattatgga gtcattttta
2701  caacgtaatt atttatatat ggtgcaatgt gtgtatatgg agaaacaaga aagacgcact
2761  ttggcttgta attctttcaa tacagatata ttttttctt tctttccctc tttcctttt
2821  taaagagaat tatacagtag aactaggtgg aaagcctagg tttggtgtat ggcttttta
2881  aaaaatatta atgcccagac caaaaaaaa caaaacaaaa aacaaaaaaa ctaataccag
2941  tcactcttga taataaagtg tttgcattat a
```

SEQ ID NO: 180 Mouse Smad6 amino acid sequence (NP_032568.3)

```
  1  mfrskrsglv rrlwrsrvvp dreegsgggg gvdedgslgs raepaprare gggcsrsevr
 61  svaprrprda vgprgaaiag rrrrtgglpr pvsesgagag gspldvaepg gpgwlpesdc
121  etvtcclfse rdaagaprds gdpqarqspe peegggprsr earsrlllle qelktvtysl
181  lkrlkersld tlleavesrg gvpggcvlvp radlrlggqp appqlllgrl frwpdlqhav
241  elkplcgchs ftaaadgptv ccnpyhfsrl cgpespppy srlsppdqyk pldlsdstls
301  yteteatnsl itapgefsda smspdatkps hwcsvayweh rtrvgrlyav ydqavsifyd
361  lpqgsgfclg qlnleqrses vrrtrskigf gillskepdg vwaynrgehp ifvnsptlda
421  pggralvvrk vppgysikvf dfersgllqh adaahgpydp hsvrisfakg wgpcysrqfi
481  tscpcwleil lnnhr
```

SEQ ID NO: 181 Human Smad7 transcript variant 1 cDNA sequence (NM_005904.3; CDS: 288-1568)

```
  1  cggagagccg cgcagggcgc gggccgcgcg gggtggggca gccggagcgc aggcccccga
 61  tccccggcgg gcgcccccgg gcccccgcgc gcgccccggc ctccgggaga ctggcgcatg
121  ccacggagcg cccctcgggc cgccgccgct cctgcccggg cccctgctgc tgctgctgtc
181  gcctgcgcct gctgccccaa ctcggcgccc gacttcttca tggtgtgcgg aggtcatgtt
```

TABLE 2-continued

| | |
|---|---|
| 241 | cgctccttag caggcaaacg acttttctcc tcgcctcctc gccccgcatg ttcaggacca |
| 301 | aacgatctgc gctcgtccgg cgtctctgga ggagccgtgc gcccggcggc gaggacgagg |
| 361 | aggagggcgc agggggaggt ggaggaggag gcgagctgcg gggagaaggg gcgacggaca |
| 421 | gccgagcgca tggggccggt ggcggcggcc cgggcagggc tggatgctgc ctgggcaagg |
| 481 | cggtgcgagg tgccaaaggt caccaccatc cccacccgcc agccgcgggc gccggcgcgg |
| 541 | ccgggggcgc cgaggcggat ctgaaggcgc tcacgcactc ggtgctcaag aaactgaagg |
| 601 | agcggcagct ggagctgctg ctccaggccg tggagtcccg cggcgggacg cgcaccgcgt |
| 661 | gcctcctgct gcccggccgc ctggactgca ggctgggccc gggggcgccc gccggcgcgc |
| 721 | agcctgcgca gccgccctcg tcctactcgc tccccctcct gctgtgcaaa gtgttcaggt |
| 781 | ggccggatct caggcattcc tcggaagtca agaggctgtg ttgctgtgaa tcttacggga |
| 841 | agatcaaccc cgagctggtg tgctgcaacc cccatcacct tagccgactc tgcgaactag |
| 901 | agtctccccc ccctccttac tccagatacc cgatggattt tctcaaacca actgcagact |
| 961 | gtccagatgc tgtgccttcc tccgctgaaa caggggggaac gaattatctg gcccctgggg |
| 1021 | ggctttcaga ttcccaactt cttctggagc ctggggatcg gtcacactgg tgcgtggtgg |
| 1081 | catactggga ggagaagacg agagtgggga ggctctactg tgtccaggag ccctctctgg |
| 1141 | atatcttcta tgatctacct caggggaatg gcttttgcct cggacagctc aattcggaca |
| 1201 | acaagagtca gctggtgcag aaggtgcgga gcaaaatcgg ctgcggcatc cagctgacgc |
| 1261 | gggaggtgga tggtgtgtgg gtgtacaacc gcagcagtta ccccatcttc atcaagtccg |
| 1321 | ccacactgga caacccggac tccaggacgc tgttggtaca caaggtgttc cccggtttct |
| 1381 | ccatcaaggc tttcgactac gagaaggcgt acagcctgca gcggcccaat gaccacgagt |
| 1441 | ttatgcagca gccgtggacg ggctttaccg tgcagatcag ctttgtgaag ggctggggcc |
| 1501 | agtgctacac ccgccagttc atcagcagct gcccgtgctg gctagaggtc atcttcaaca |
| 1561 | gccggtagcc gcgtgcggag gggacagagc gtgagctgag caggccacac ttcaaactac |
| 1621 | tttgctgcta atattttcct cctgagtgct tgcttttcat gcaaactctt tggtcgtttt |
| 1681 | tttttgttt gttggttggt tttcttcttc tcgtcctcgt ttgtgttctg ttttgtttcg |
| 1741 | ctctttgaga aatagcttat gaaaagaatt gttgggggtt tttttggaag aaggggcagg |
| 1801 | tatgatcggc aggacaccct gataggaaga ggggaagcag aaatccaagc accaccaaac |
| 1861 | acagtgtatg aaggggggcg gtcatcattt cacttgtcag gagtgtgtgt gagtgtgagt |
| 1921 | gtgcggctgt gtgtgcacgc gtgtgcagga gcggcagatg gggagacaac gtgctctttg |
| 1981 | ttttgtgtct cttatggatg tccccagcag agaggtttgc agtcccaagc ggtgtctctc |
| 2041 | ctgccccttg gacacgctca gtggggcaga ggcagtacct gggcaagctg gcggctgggg |
| 2101 | tcccagcagc tgccaggagc acggctctgt ccccagcctg ggaaagcccc tgcccctcct |
| 2161 | ctccctcatc aaggacacgg gcctgtccac aggcttctga gcagcgagcc tgctagtggc |
| 2221 | cgaaccagaa ccaattattt tcatccttgt cttattccct tcctgccagc ccctgccatt |
| 2281 | gtagcgtctt tctttttggg ccatctgctc ctggatctcc ctgagatggg cttcccaagg |
| 2341 | gctgccgggg cagccccctc acagtattgc tcacccagtg ccctctcccc tcagcctctc |
| 2401 | ccctgcctgc cctggtgaca tcaggttttt cccggactta gaaaaccagc tcagcactgc |
| 2461 | ctgctcccat cctgtgtgtt aagctctgct attaggccag caagcgggga tgtccctggg |
| 2521 | agggacatgc ttagcagtcc ccttccctcc aagaaggatt tggtccgtca taacccaagg |
| 2581 | taccatccta ggctgacacc taactcttct ttcatttctt ctacaactca tacactcgta |

TABLE 2-continued

```
2641  tgatacttcg acactgttct tagctcaatg agcatgttta gactttaaca taagctattt
2701  ttctaactac aaaggtttaa atgaacaaga gaagcattct cattggaaat ttagcattgt
2761  agtgctttga gagagaaagg actcctgaaa aaaaacctga gatttattaa agaaaaaaat
2821  gtattttatg ttatatataa atatattatt acttgtaaat ataaagacgt tttataagca
2881  tcattattta tgtattgtgc aatgtgtata aacaagaaaa ataaagaaaa gatgcacttt
2941  gctttaatat aaatgcaaat aacaaatgcc aaattaaaaa agataaacac aagattggtg
3001  tttttttcta tgggtgttat cacctagctg aatgtttttc taaaggagtt tatgttccat
3061  taaacgattt ttaaaatgta cacttgaa
```

SEQ ID NO: 182 Human Smad7 isoform 1 amino acid sequence (NP_005895.1)

```
  1  mfrtkrsalv rrlwrsrapg gedeeegagg gggggelrge gatdsrahga ggggpgragc
 61  clgkavrgak ghhhphppaa gagaaggaea dlkalthsvl kklkerqlel llqavesrgg
121  trtaclllpg rldcrlgpga pagaqpaqpp ssyslplllc kvfrwpdlrh ssevkrlccc
181  esygkinpel vccnphhlsr lcelespppp ysrypmdflk ptadcpdavp ssaetggtny
241  lapgglsdsq lllepgdrsh wcvvayweek trvgrlycvq epsldifydl pqgngfclgq
301  lnsdnksqlv qkvrskigcg iqltrevdgv wvynrssypi fiksatldnp dsrtllvhkv
361  fpgfsikafd yekayslqrp ndhefmqqpw tgftvqisfv kgwgqcytrq fisscpcwle
421  vifnsr
```

SEQ ID NO: 183 Human Smad7 transcript variant 2 cDNA sequence (NM_001190821.1; CDS: 288-1565)

```
   1  cggagagccg cgcagggcgc gggccgcgcg gggtggggca gccggagcgc aggcccccga
  61  tccccggcgg gcgcccccgg gcccccgcgc gcgcccccggc ctccgggaga ctggcgcatg
 121  ccacggagcg cccctcgggc cgccgccgct cctgcccggg cccctgctgc tgctgctgtc
 181  gcctgcgcct gctgccccaa ctcggcgccc gacttcttca tggtgtgcgg aggtcatgtt
 241  cgctccttag caggcaaacg acttttctcc tcgcctcctc gccccgcatg ttcaggacca
 301  aacgatctgc gctcgtccgg cgtctctgga ggagccgtgc gcccggcggc gaggacgagg
 361  aggagggcgc agggggaggt ggaggaggag gcgagctgcg gggagaaggg gcgacggaca
 421  gccgagcgca tggggccggt ggcggcggcc cgggcagggc tggatgctgc ctgggcaagg
 481  cggtgcgagg tgccaaaggt caccaccatc cccacccgcc agccgcgggc gccggcgcgg
 541  ccgggggcgc cgaggcggat ctgaaggcgc tcacgcactc ggtgctcaag aaactgaagg
 601  agcggcagct ggagctgctg ctccaggccg tggagtcccg cggcgggacg cgcaccgcgt
 661  gcctcctgct gcccggccgc ctggactgca ggctgggccc gggggcgccc gccggcgcgc
 721  agcctgcgca gccgccctcg tcctactcgc tcccccctcct gctgtgcaaa gtgttcaggt
 781  ggccggatct caggcattcc tcggaagtca agaggctgtg ttgctgtgaa tcttacggga
 841  agatcaaccc cgagctggtg tgctgcaacc cccatcacct tagccgactc tgcgaactag
 901  agtctccccc ccctccttac tccagatacc cgatggattt tctcaaacca actgactgtc
 961  cagatgctgt gccttcctcc gctgaaacag gggaacgaa ttatctggcc cctgggggc
1021  tttcagattc ccaacttctt ctggagcctg gggatcggtc acactggtgc gtggtggcat
1081  actgggagga gaagacgaga gtggggaggc tctactgtgt ccaggagccc tctctggata
1141  tcttctatga tctacctcag ggaatggct tttgcctcgg acagctcaat tcggacaaca
1201  agagtcagct ggtgcagaag gtgcggagca aaatcggctg cggcatccag ctgacgcggg
1261  aggtggatgg tgtgtgggtg tacaaccgca gcagttaccc catcttcatc aagtccgcca
1321  cactggacaa cccggactcc aggacgctgt tggtacacaa ggtgttcccc ggtttctcca
```

TABLE 2-continued

| | |
|---|---|
| 1381 | tcaaggcttt cgactacgag aaggcgtaca gcctgcagcg gcccaatgac cacgagttta |
| 1441 | tgcagcagcc gtggacgggc tttaccgtgc agatcagctt tgtgaagggc tggggccagt |
| 1501 | gctacacccg ccagttcatc agcagctgcc cgtgctggct agaggtcatc ttcaacagcc |
| 1561 | ggtagccgcg tgcggagggg acagagcgtg agctgagcag gccacacttc aaactacttt |
| 1621 | gctgctaata ttttcctcct gagtgcttgc ttttcatgca aactctttgg tcgttttttt |
| 1681 | tttgtttgtt ggttggtttt cttcttctcg tcctcgtttg tgttctgttt tgtttcgctc |
| 1741 | tttgagaaat agcttatgaa aagaattgtt gggggttttt ttggaagaag ggcaggtat |
| 1801 | gatcggcagg acaccctgat aggaagaggg gaagcagaaa tccaagcacc accaaacaca |
| 1861 | gtgtatgaag gggggcggtc atcatttcac ttgtcaggag tgtgtgtgag tgtgagtgtg |
| 1921 | cggctgtgtg tgcacgcgtg tgcaggagcg gcagatgggg agacaacgtg ctctttgttt |
| 1981 | tgtgtctctt atggatgtcc ccagcagaga ggtttgcagt cccaagcggt gtctctcctg |
| 2041 | ccccttggac acgctcagtg gggcagaggc agtacctggg caagctggcg gctggggtcc |
| 2101 | cagcagctgc caggagcacg gctctgtccc cagcctggga aagcccctgc ccctcctctc |
| 2161 | cctcatcaag gacacgggcc tgtccacagg cttctgagca gcgagcctgc tagtggccga |
| 2221 | accagaacca attattttca tocttgtott attcccttcc tgccagcccc tgccattgta |
| 2281 | gcgtctttct tttttggcca tctgctcctg gatctccctg agatgggctt cccaagggct |
| 2341 | gccggggcag ccccctcaca gtattgctca cccagtgccc tctcccctca gcctctcccc |
| 2401 | tgcctgccct ggtgacatca ggtttttccc ggacttagaa aaccagctca gcactgcctg |
| 2461 | ctcccatcct gtgtgttaag ctctgctatt aggccagcaa gcggggatgt ccctgggagg |
| 2521 | gacatgctta gcagtcccct tccctccaag aaggatttgg tccgtcataa cccaaggtac |
| 2581 | catcctaggc tgacacctaa ctcttctttc atttcttcta caactcatac actcgtatga |
| 2641 | tacttcgaca ctgttcttag ctcaatgagc atgtttagac tttaacataa gctatttttc |
| 2701 | taactacaaa ggtttaaatg aacaagagaa gcattctcat tggaaattta gcattgtagt |
| 2761 | gctttgagag agaaaggact cctgaaaaaa aacctgagat ttattaaaga aaaaaatgta |
| 2821 | ttttatgtta tatataaata tattattact tgtaaatata aagacgtttt ataagcatca |
| 2881 | ttatttatgt attgtgcaat gtgtataaac aagaaaaata aagaaaagat gcactttgct |
| 2941 | ttaatataaa tgcaaataac aaatgccaaa ttaaaaaaga taaacacaag attggtgttt |
| 3001 | ttttctatgg gtgttatcac ctagctgaat gtttttctaa aggagtttat gttccattaa |
| 3061 | acgattttta aaatgtacac ttgaa |

SEQ ID NO: 184 Human Smad7 isoform 2 amino acid sequence (NP_001177750.1)

| | |
|---|---|
| 1 | mfrtkrsalv rrlwrsrapg gedeeegagg gggggelrge gatdsrahga ggggpgragc |
| 61 | clgkavrgak ghhhphppaa gagaaggaea dlkalthsvl kklkerqlel llqavesrgg |
| 121 | trtaclllpg rldcrlgpga pagaqpaqpp ssyslplllc kvfrwpdlrh ssevkrlccc |
| 181 | esygkinpel vccnphhlsr lcelespppp ysrypmdflk ptdcpdavps saetggtnyl |
| 241 | apgglsdsql llepgdrshw cvvayweekt rvgrlycvqe psldifydlp qgngfclgql |
| 301 | nsdnksqlvq kvrskigcgi qltrevdgvw vynrssypif iksatldnpd srtllvhkvf |
| 361 | pgfsikafdy ekayslqrpn dhefmqqpwt gftvqisfvk gwgqcytrqf isscpcwlev |
| 421 | ifnsr |

TABLE 2-continued

SEQ ID NO: 185 Human Smad7 transcript variant 3 cDNA sequence
NM_001190822.2; CDS: 138-773)

```
   1 agtaaatacg gagaatcacg tcgaacacca gtggcccaga tactgtcgtg gccgcgcacc
  61 tttggagttt tggggcaaag agagttggat ggaaggccga actggagtct cccccccctc
 121 cttactccag atacccgatg gattttctca aaccaactgc agactgtcca gatgctgtgc
 181 cttcctccgc tgaaacaggg ggaacgaatt atctggcccc tggggggctt tcagattccc
 241 aacttcttct ggagcctggg gatcggtcac actggtgcgt ggtggcatac tgggaggaga
 301 agacgagagt ggggaggctc tactgtgtcc aggagccctc tctggatatc ttctatgatc
 361 tacctcaggg gaatggcttt tgcctcggac agctcaattc ggacaacaag agtcagctgg
 421 tgcagaaggt gcggagcaaa atcggctgcg gcatccagct gacgcgggag gtggatggtg
 481 tgtgggtgta caaccgcagc agttacccca tcttcatcaa gtccgccaca ctggacaacc
 541 cggactccag gacgctgttg gtacacaagg tgttccccgg tttctccatc aaggctttcg
 601 actacgagaa ggcgtacagc ctgcagcggc ccaatgacca cgagtttatg cagcagccgt
 661 ggacgggctt taccgtgcag atcagctttg tgaagggctg gggccagtgc tacacccgcc
 721 agttcatcag cagctgcccg tgctggctag aggtcatctt caacagccgg tagccgcgtg
 781 cggaggggac agagcgtgag ctgagcaggc cacacttcaa actactttgc tgctaatatt
 841 ttcctcctga gtgcttgctt ttcatgcaaa ctctttggtc gttttttttt tgtttgttgg
 901 ttggttttct tcttctcgtc ctcgtttgtg ttctgttttg tttcgctctt tgagaaatag
 961 cttatgaaaa gaattgttgg gggttttttt ggaagaaggg gcaggtatga tcggcaggac
1021 accctgatag gaagagggga agcagaaatc caagcaccac caaacacagt gtatgaaggg
1081 gggcggtcat catttcactt gtcaggagtg tgtgtgagtg tgagtgtgcg gctgtgtgtg
1141 cacgcgtgtg caggagcggc agatggggag acaacgtgct ctttgttttg tgtctcttat
1201 ggatgtcccc agcagagagg tttgcagtcc caagcggtgt ctctcctgcc ccttggacac
1261 gctcagtggg gcagaggcag tacctgggca agctggcggc tggggtccca gcagctgcca
1321 ggagcacggc tctgtcccca gcctgggaaa gcccctgccc ctcctctccc tcatcaagga
1381 cacgggcctg tccacaggct tctgagcagc gagcctgcta gtggccgaac cagaaccaat
1441 tattttcatc cttgtcttat tcccttcctg ccagcccctg ccattgtagc gtctttcttt
1501 tttggccatc tgctcctgga tctccctgag atgggcttcc caagggctgc cggggcagcc
1561 ccctcacagt attgctcacc cagtgccctc tcccctcagc ctctcccctg cctgccctgg
1621 tgacatcagg tttttcccgg acttagaaaa ccagctcagc actgcctgct cccatcctgt
1681 gtgttaagct ctgctattag gccagcaagc ggggatgtcc ctgggaggga catgcttagc
1741 agtccccttc cctccaagaa ggatttggtc cgtcataacc caaggtacca tcctaggctg
1801 acacctaact cttctttcat ttcttctaca actcatacac tcgtatgata cttcgacact
1861 gttcttagct caatgagcat gtttagactt taacataagc tatttttcta actacaaagg
1921 tttaaatgaa caagagaagc attctcattg gaaatttagc attgtagtgc tttgagagag
1981 aaaggactcc tgaaaaaaaa cctgagattt attaaagaaa aaaatgtatt ttatgttata
2041 tataaatata ttattacttg taaatataaa gacgttttat aagcatcatt atttatgtat
2101 tgtgcaatgt gtataaacaa gaaaaataaa gaaaagatgc actttgcttt aatataaatg
2161 caaataacaa atgccaaatt aaaaaagata aacacaagat tggtgttttt ttctatgggt
2221 gttatcacct agctgaatgt ttttctaaag gagtttatgt tccattaaac gatttttaaa
2281 atgtacactt ga
```

TABLE 2-continued

SEQ ID NO: 186 Human Smad7 isoform 3 amino acid sequence (NP_001177751.1)

```
  1 mdflkptadc pdavpssaet ggtnylapgg lsdsqlllep gdrshwcvva yweektrvgr
 61 lycvqepsld ifydlpqgng fclgqlnsdn ksqlvqkvrs kigcgiqltr evdgvwvynr
121 ssypifiksa tldnpdsrtl lvhkvfpgfs ikafdyekay slqrpndhef mqqpwtgftv
181 qisfvkgwgq cytrqfissc pcwlevifns r
```

SEQ ID NO: 187 Human Smad7 transcript variant 4 cDNA sequence NM_001190823.1; CDS: 150-866)

```
   1 agtctcattg agcctgactc gagtaatgat taactggctg cccggagccc agacgggtga
  61 caaggtgctg tggtctgtct tacgatgggc agtgaagcct gagcagacca ttaataatca
 121 gcatcaaggc cgcgagtcag ccttttggaa tgtgtggttt gtctttcatg ctgtttagag
 181 cgtgcttaaa gatggatctt ggtgttttta tttgtgtatt tatttctttc tctccccttt
 241 tcaaatccac agcagactgt ccagatgctg tgccttcctc cgctgaaaca gggggaacga
 301 attatctggc ccctgggggg ctttcagatt cccaacttct tctggagcct ggggatcggt
 361 cacactggtg cgtggtggca tactgggagg agaagacgag agtggggagg ctctactgtg
 421 tccaggagcc ctctctggat atcttctatg atctacctca ggggaatggc ttttgcctcg
 481 gacagctcaa ttcggacaac aagagtcagc tggtgcagaa ggtgcggagc aaaatcggct
 541 gcggcatcca gctgacgcgg gaggtggatg gtgtgtgggt gtacaaccgc agcagttacc
 601 ccatcttcat caagtccgcc acactggaca acccggactc caggacgctg ttggtacaca
 661 aggtgttccc cggtttctcc atcaaggctt tcgactacga gaaggcgtac agcctgcagc
 721 ggcccaatga ccacgagttt atgcagcagc cgtggacggg ctttaccgtg cagatcagct
 781 ttgtgaaggg ctggggccag tgctacaccc gccagttcat cagcagctgc ccgtgctggc
 841 tagaggtcat cttcaacagc cggtagccgc gtgcggaggg gacagagcgt gagctgagca
 901 ggccacactt caaactactt tgctgctaat attttcctcc tgagtgcttg cttttcatgc
 961 aaactctttg gtcgtttttt ttttgtttgt tggttggttt tcttcttctc gtcctcgttt
1021 gtgttctgtt ttgtttcgct ctttgagaaa tagcttatga aaagaattgt tgggggtttt
1081 tttggaagaa ggggcaggta tgatcggcag gacaccctga taggaagagg ggaagcagaa
1141 atccaagcac caccaaacac agtgtatgaa ggggggcggt catcatttca cttgtcagga
1201 gtgtgtgtga gtgtgagtgt gcggctgtgt gtgcacgcgt gtgcaggagc ggcagatggg
1261 gagacaacgt gctctttgtt ttgtgtctct tatggatgtc cccagcagag aggtttgcag
1321 tcccaagcgg tgtctctcct gccccttgga cacgctcagt ggggcagagg cagtacctgg
1381 gcaagctggc ggctggggtc ccagcagctg ccaggagcac ggctctgtcc ccagcctggg
1441 aaagcccctg cccctcctct ccctcatcaa ggacacgggc ctgtccacag gcttctgagc
1501 agcgagcctg ctagtggccg aaccagaacc aattattttc atccttgtct tattcccttc
1561 ctgccagccc ctgccattgt agcgtctttc ttttttggcc atctgctcct ggatctccct
1621 gagatgggct tcccaagggc tgccggggca gccccctcac agtattgctc acccagtgcc
1681 ctctcccctc agcctctccc ctgcctgccc tggtgacatc aggtttttcc cggacttaga
1741 aaaccagctc agcactgcct gctcccatcc tgtgtgttaa gctctgctat taggccagca
1801 agcggggatg tccctgggag ggacatgctt agcagtcccc ttccctccaa gaaggatttg
1861 gtccgtcata acccaaggta ccatcctagg ctgacaccta actcttcttt catttcttct
1921 acaactcata cactcgtatg atacttcgac actgttctta gctcaatgag catgtttaga
1981 ctttaacata agctattttt ctaactacaa aggtttaaat gaacaagaga agcattctca
```

TABLE 2-continued 2041 ttggaaattt agcattgtag tgctttgaga gagaaaggac tcctgaaaaa aaacctgaga 2101 tttattaaag aaaaaaatgt attttatgtt atatataaat atattattac ttgtaaatat 2161 aaagacgttt tataagcatc attatttatg tattgtgcaa tgtgtataaa caagaaaaat 2221 aaagaaaaga tgcactttgc tttaatataa atgcaaataa caaatgccaa attaaaaaag 2281 ataaacacaa gattggtgtt tttttctatg ggtgttatca cctagctgaa tgtttttcta 2341 aaggagttta tgttccatta aacgattttt aaaatgtaca cttgaa SEQ ID NO: 188 Human Smad7 isoform 4 amino acid sequence (NP_001177752.1)

1 mcglsfmlfr aclkmdlgvf icvfisfspl fkstadcpda vpssaetggt nylapgglsd 61 sqlllepgdr shwavvaywe ektrvgrlyc vqepsldify dlpqgngfcl gqlnsdnksq 121 lvqkvrskig cgiqltrevd gvwvynrssy pifiksatld npdsrtllvh kvfpgfsika 181 fdyekayslq rpndhefmqq pwtgftvqis fvkgwgqcyt rqfisscpcw levifnsr SEQ ID NO: 189 Mouse Smad7 cDNA sequence (NM_001042660.1; CDS: 1592-2872)

1 ttcgctcgct gatcggcgca cagaggatct tgtccccgag ctgcgccagc agagccagcc 61 gggcgcctcg ctcggtccgc tcgccgcgcc ggagagagct gcctgagacg cagccagcca 121 gccagccggc gccacgccgc cgagcgctcg gccccggagt ccctgagtgc ggcgcggcga 181 gcccccagcg gcggcagaag gactcgagcg ccaggagagg gcggacgggg gacgaggagg 241 ctccggggcg cgacgaagag agtctccgag gaagaggctg cgagaggaca cccgggcctc 301 ctgccgccac tgtcgggtcg gggccagcag ctcatgagag cagccccggc ggccacccgc 361 ggccaggaga aggagcaccg gaggccccca cactagcctg tgccctcggg ggcgagagct 421 tgcgacccgc cggagcccgc cgccgcgccg ccctcccccg cgctgacagc coccoggggc 481 gcagccgccg ccgcagcatc ttctgtccct gcttccccag cgcggaggaa gtccccgccg 541 aggacctggg cccccgggaa cgcaggagga aagaccagag actctaaaac acccagatac 601 gcaagattga agcagcctag ccagaccttt ctgtggatta aaagaaatac gatttttttt 661 ttttttttgg cagaagaaaa ggaaaggaag accggctggg ttcagcaagg aaaaaaaggg 721 ggatgtaact cgtggatacg gttttttttcc cccacccttc caacatcttg ttttactttg 781 taaacatttt ctcttttaaa cccgggctcc atccggtgcc ctccagacct ccgaggtgcg 841 aggaggtggt gtgttttttc attgggggct ttgcatattt tggttttggg ggttttgaga 901 gaccctccag acatctcacg aggggtgaag tctactcggt cccctccctc aagtcttcgc 961 gtgcacagaa ttcgaggaga tccggttact aaggatatag aagaaaaaaa ataaatcgtg 1021 cctgcctttt ttttttaatt gcctgcttct ccccaccccc aaattaagtt gcttagcaag 1081 ggggaaagag gotttttcct ccctttagta gctcagccta acgtctttcg tttttttttt 1141 tttttttttg cccccgagga tcttccatgt aggaagccga ggctggcgag cccgacactc 1201 gggagccact gtagggggc ctttttgggg ggaggcgtct accggggttg cctcggccgc 1261 ccccagggaa gcggcggccg cgttcctcca gggcacgccg gggcccgaaa gccgcgcagg 1321 gcgcgggccg cgccgggtgg ggcagccgaa gcgcagcccc ccgatccccg gcaggcgccc 1381 ctgggccccc gcgcgcgccc cggcctctgg gagactggcg catgccacgg agcgcccctc 1441 gggccgccgc cgcttctgcc cgggcccctg ctgttgctgc tgtcgcctgc gcctgctgcc 1501 ccaactcggc gcccgacttc ttcatggtgt gcggaggtca tgttcgctcc ttagccggca 1561 aacgactttt ctcctcgcct cctcgcccog catgttcagg accaaacgat ctgcgctcgt 1621 ccggcgtctc tggaggagcc gtgcgcccgg cggcgaggac gaggaggagg gcgtgggggg 1681 tggcggcgga ggaggcgagc tgcggggaga aggggcgacg gacggccggg cttatggggc TABLE 2-continued

| | |
|---|---|
| 1741 | tggtggcggc ggtgcgggca gggctggctg ctgcctgggc aaggcagtcc gaggtgccaa |
| 1801 | aggtcaccac catccccatc ccccaacctc gggtgccggg gcggccgggg gcgccgaggc |
| 1861 | ggatctgaag gcgctcacgc actcggtgct caagaaactc aaggagcggc agctggagct |
| 1921 | gctgcttcag gccgtggagt cccgcggcgg tacgcgcacc gcgtgcctcc tgctgcccgg |
| 1981 | ccgcctggac tgcaggctgg gcccgggggc gcccgccagc gcgcagcccg cgcagccgcc |
| 2041 | ctcgtcctac tcgctccccc tcctgctgtg caaagtgttc aggtggccgg atctcaggca |
| 2101 | ttcctcggaa gtcaagaggc tgtgttgctg tgaatcttac gggaagatca accccgagct |
| 2161 | ggtgtgctgc aacccccatc accttagtcg actctgtgaa ctagagtctc cccctcctcc |
| 2221 | ttactccaga tacccaatgg attttctcaa accaactgca ggctgtccag atgctgtacc |
| 2281 | ttcctccgcg gaaaccgggg gaacgaatta tctggcccct ggggggcttt cagattccca |
| 2341 | acttcttctg gagcctgggg atcggtcaca ctggtgcgtg gtggcatact gggaggagaa |
| 2401 | gactcgcgtg ggaggctct actgtgtcca agagccctcc ctggatatct tctatgatct |
| 2461 | acctcagggg aatggctttt gcctcggaca gctcaattcg gacaacaaga gtcagctggt |
| 2521 | acagaaagtg cggagcaaga tcggctgtgg catccagctg acgcgggaag tggatggcgt |
| 2581 | gtgggtttac aaccgcagca gttaccccat cttcatcaag tccgccacac tggacaaccc |
| 2641 | ggactccagg acgctgttgg tgcacaaagt gttccctggt ttctccatca aggcttttga |
| 2701 | ctatgagaaa gcctacagcc tgcagcggcc caatgaccac gagttcatgc agcaaccatg |
| 2761 | gacgggtttc accgtgcaga tcagctttgt gaagggctgg ggccagtgct acacccgcca |
| 2821 | gttcatcagc agctgcccgt gctggctgga ggtcatcttc aacagccggt agtcggtcgt |
| 2881 | gtggtgggga gaagaggaca gggcggatcg tgagccgagc aggccaccgt tcaaactact |
| 2941 | tgctgctaac ctttcccgag tgattgcttt tcatgcaaac tctttggttg gtgttgttat |
| 3001 | tgccattcat tgttggtttt gttttgttct gttctggttt gttttttttt ttttttcctc |
| 3061 | ctcctttctc gtcatccgtg tgtcccgctt gtcttgttct ttgagaaatt agcttatggt |
| 3121 | gcggattttt gttgggttgt gtgtgtgtgt tttgtttttg ttttgaggtg gtgggtgtgg |
| 3181 | ttggcaggac accccctccc cccatatacg aagacaggaa acgagagtca gcactgccaa |
| 3241 | gcatggtgtg tgaaagtggg caccaccttc cctttggatc agcgtttcgg ttgtccgtgc |
| 3301 | gtaggggtgt acccgagcga cagatggggg aagtgctttt ttgtgtgtgt gttctttatg |
| 3361 | gatgcccccg gctgagaggc tcatagtgcc aagctgtgtg tctctctagc cttttggaca |
| 3421 | cgctcggtgg ggcagaggca gtacctgggc agactggcag caggtgccaa gctctgctcc |
| 3481 | agcctgccga agctgccccg ccccgccccg cccccgcccc cacaggacac gggcctatcc |
| 3541 | acaggcttct gagaagccag cctgctagaa ggctgaacca gaaccaattg ttttcatccc |
| 3601 | tgtcttactg ccgcctgtca cccgctgcca ttgtcgagtc tgtctttttt ggccatctgc |
| 3661 | tcctggatct ctctcttgag atgggcttcc caagggctgc cgggacagcc ccagtcacag |
| 3721 | tattgctacc ccagtaccct ctcaggccct tccaccgggt cccagccgtg gtggtttttt |
| 3781 | catcaggttt ctcccagatg tggaaagtca gctcagcacc ccatccccca tcctgtgtgc |
| 3841 | tgagctctgt agaccagcga ggggcatcag ggagggacct gcgcagtgcc ccccccttcct |
| 3901 | gctgagaagg gtgtagcccc gtcacaacaa aggtaccatc ccttggctgg ctcccagccc |
| 3961 | ttctctcagc tcatacgctc gctcgtatga tactttgaca ctgttcttag ctcaatgagc |
| 4021 | atgtttagaa tttaacataa gctatttttc taactacaaa ggtttaaatg aacaagagaa |
| 4081 | gcattctcat tggaaattta gcattgtagt gctttgagag aggaaaggac tccttaaaag |

TABLE 2-continued

| | |
|---|---|
| 4141 | aaaaaaaaag ctgagattta ttaaagaaaa atgtatttta tgttatatat aaatatatta |
| 4201 | ttacttgtaa atataaagac gttttataag catcattatt tatgtattgt gcaatgtgta |
| 4261 | taaacgagaa gaataaagaa aagatgcact ttgctttaat ataaatgcaa ataacatgcc |
| 4321 | aaattaaaaa aaaaaagata aacacaagat tggtgttttt ttctatgggt gttatcacct |
| 4381 | agctgaatgt ttttctaaag gagtttatgt tccattaaac aatttttaaa atgtatactg |
| 4441 | c |
| SEQ ID NO: 190 Mouse Smad amino acid sequence (NP_001036125.1) | |
| 1 | mfrtkrsalv rriwrsrapg gedeeegvgg gggggelrge gatdgrayga ggggagragc |
| 61 | clgkavrgak ghhhphppts gagaaggaea dlkalthsvl kklkerqlel llqavesrgg |
| 121 | trtaclllpg rldcrlgpga pasaqpaqpp ssyslplllc kvfrwpdlrh ssevkrlccc |
| 181 | esygkinpel vccnphhlsr lcelespppp ysrypmdflk ptagcpdavp ssaetggtny |
| 241 | lapgglsdsq lllepgdrsh wcvvayweek trvgrlycvq epsldifydl pqgngfclgq |
| 301 | lnsdnksqlv qkvrskigcg iqltrevdgv wvynrssypi fiksatldnp dsrtllvhkv |
| 361 | fpgfsikafd yekayslqrp ndhefmqqpw tgftvgisfv kgwgqcytrq fisscpcwle |
| 421 | vifnsr |

Included in Table 2 are nucleic acid molecules comprising a nucleic acid sequence having at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity to the region encoding the DNA binding domain or across their full length with a nucleic acid sequence of any SEQ ID NO listed in Table 2. Such nucleic acid molecules can encode a polypeptide having a function of the full-length polypeptide as described further herein.

Included in Table 2 are polypeptide molecules comprising an amino acid sequence having at least 30%, 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5%, or more identity to the DNA binding domain or across their full length with an amino acid sequence of any SEQ ID NO listed in Table 2. Such polypeptides can have a function of the full-length polypeptide as described further herein.

II. Cancer Vaccine

The present invention provides a cancer vaccine comprising cancer cells, wherein the cancer cells are (1) PTEN-deficient, (2) p53-deficient, and (3) modified to activate the TGFβ-Smad/p63 signaling pathway. The cancer cells may be derived from a solid or hematological cancer (e.g., breast cancer). In certain embodiments, the breast cancer cells are triple-negative breast cancer (TNBC). In one embodiment, the cancer cells are derived from a subject. For example, the cancer cells may be derived from a breast cancer driven by co-loss of p53 and PTEN. In another embodiment, the cancer cells are derived from a cancer cell line. The cancer cells may be from any cancer cell line or primary cancer cells. For example, the cancer cells may be derived from a cell line selected from the group consisting of HCC1954, SUM149, BxPC-3, T3M4, 143B, A549, H520, H23, HaCaT, H357, H400, Detroit, OKF6, BICR6, H103, SPT, JHU12, JHU22, HSC3, SCC25, and NTERT cells. The cancer cells may have different kinds of additional genetic mutations. The cancer cells may be derived from the subject who is treated with the cancer vaccine. The cancer cells may also be derived from a different subject who is not treated with the cancer vaccine. The cancer cells may be derived from a cancer that is the same type as the cancer treated with the cancer vaccine. The cancer cells may also be derived from a cancer that is a different type from the cancer treated with the cancer vaccine. The cancer cells may be derived from a cancer that has the same genetic mutations as the cancer treated with the cancer vaccine. The cancer cells may also be derived from a cancer that has different genetic mutations from the cancer treated with the cancer vaccine.

a. Cancer Cell Isolation and Purification

In some embodiments, the cancer cells are derived from a subject. Isolation and purification of tumor cell from various tumor tissues such as surgical tumor tissues, ascites or carcinous hydrothorax is a common process to obtain the purified tumor cells. Cancer cells may be purified from fresh biopsy samples from cancer patients or animal tumor models. The biopsy samples often contain a heterogeneous population of cells that include normal tissue, blood, and cancer cells. Preferably, a purified cancer cell composition can have greater than 10%, 20% 30%, 40%, 50%, 60%, 70%, 75%, 80%, 85%, 90%, 95%, 99%, or more, or any range in between or any value in between, total viable cancer cells. To purify cancer cells from the heterogeneous population, a number of methods can be used.

In one embodiment, laser microdissection is used to isolate cancer cells. Cancer cells of interest can be carefully dissected from thin tissue slices prepared for microscopy. In this method, the tissue section is coated with a thin plastic film and an area containing the selected cells is irradiated with a focused infrared laser beam pulse. This melts a small circle in the plastic film, causing cell binding underneath. Those captured cells are removed for additional analysis. This technique is good for separating and analyzing cells from different parts of a tumor, which allows for a comparison of their similar and distinct properties. It was used recently to analyze pituitary cells from dissociated tissues and from cultured populations of heterogeneous pituitary, thyroid, and carcinoid tumor cells, as well as analyzing single cells found in various sarcomas.

In another embodiment, fluorescence activated cell sorting (FACS), also referred to as flow cytometry, is used to sort and analyze the different cell populations. Cells having a cellular marker or other specific marker of interest are tagged with an antibody, or typically a mixture of antibodies, that bind the cellular markers. Each antibody directed to a different marker is conjugated to a detectable molecule, particularly a fluorescent dye that may be distinguished from other fluorescent dyes coupled to other antibodies. A stream of tagged or "stained" cells is passed through a light source that excites the fluorochrome and the emission spectrum from the cells detected to determine the presence of a particular labeled antibody. By concurrent detection of different fluorochromes, also referred to in the art as multicolor fluorescence cell sorting, cells displaying different sets of cell markers may be identified and isolated from other cells in the population. Other FACS parameters, including, by way of example and not limitation, side scatter (SSC), forward scatter (FSC), and vital dye staining (e.g., with propidium iodide) allow selection of cells based on size and viability. FACS sorting and analysis of HSC and related lineage cells is well-known in the art and described in, for example, U.S. Pat. Nos. 5,137,809; 5,750,397; 5,840,580; 6,465,249; Manz et al. (202) *Proc. Natl. Acad. Sci. U.S.A.* 99:11872-11877; and Akashi et al. (200) *Nature* 404:193-197. General guidance on fluorescence activated cell sorting is described in, for example, Shapiro (2003) *Practical Flow Cytometry,* 4th Ed., Wiley-Liss (2003) and Ormerod (2000) *Flow Cytometry: A Practical Approach,* 3rd Ed., Oxford University Press.

Another method of isolating useful cell populations involves a solid or insoluble substrate to which is bound antibodies or ligands that interact with specific cell surface markers. In immunoadsorption techniques, cells are contacted with the substrate (e.g., column of beads, flasks, magnetic particles, etc.) containing the antibodies and any unbound cells removed. Immunoadsorption techniques may be scaled up to deal directly with the large numbers of cells in a clinical harvest. Suitable substrates include, by way of example and not limitation, plastic, cellulose, dextran, polyacrylamide, agarose, and others known in the art (e.g., Pharmacia Sepharose 6 MB macrobeads). When a solid substrate comprising magnetic or paramagnetic beads is used, cells bound to the beads may be readily isolated by a magnetic separator (see, e.g., Kato and Radbruch (1993) *Cytometry* 14:384-92). Affinity chromatographic cell separations typically involve passing a suspension of cells over a support bearing a selective ligand immobilized to its surface. The ligand interacts with its specific target molecule on the cell and is captured on the matrix. The bound cell is released by the addition of an elution agent to the running buffer of the column and the free cell is washed through the column and harvested as a homogeneous population. As apparent to the skilled artisan, adsorption techniques are not limited to those employing specific antibodies, and may use nonspecific adsorption. For example, adsorption to silica is a simple procedure for removing phagocytes from cell preparations. One of the most common uses of this technology is for isolating circulating tumor cells (CTCs) from the blood of breast, NSC lung cancer, prostate and colon cancer patients using an antibody against EpCAM, a cell surface glycoprotein that has been found to be highly expressed in epithelial cancers.

FACS and most batch wise immunoadsorption techniques may be adapted to both positive and negative selection procedures (see, e.g., U.S. Pat. No. 5,877,299). In positive selection, the desired cells are labeled with antibodies and removed away from the remaining unlabeled/unwanted cells. In negative selection, the unwanted cells are labeled and removed. Another type of negative selection that may be employed is use of antibody/complement treatment or immunotoxins to remove unwanted cells.

In still another embodiment, microfluidics, one of the newest technologies, is used to isolate cancer cells. This method used a microfluidic chip with a spiral channel that can isolate circulating tumor cells (CTCs) from blood based upon their size. A sample of blood is pumped into the device and as cells flow through the channel at high speeds, the inertial and centrifugal forces cause smaller cells to flow along the outer wall while larger cells, including CTCs, flow along the inner wall. Researchers have used this chip technology to isolate CTCs from the blood of patients with metastatic lung or breast cancer.

Fluorescent nanodiamonds (FNDs), according to a recently published article (Lin et al. *Small* (2015) 11:4394-4402), can be used to label and isolate slow-proliferating/quiescent cancer stem cells, which, according to study authors, have been difficult to isolate and track over extended time periods using traditional fluorescent markers. It was concluded that nanoparticles do not cause DNA damage or impair cell growth, and that they outperformed EdU and CFSE fluorescent labels in terms of long-term tracking capability.

It is to be understood that the purification or isolation of cells also includes combinations of the methods described above. A typical combination may comprise an initial procedure that is effective in removing the bulk of unwanted cells and cellular material. A second step may include isolation of cells expressing a marker common to one or more of the progenitor cell populations by immunoadsorption on antibodies bound to a substrate. An additional step providing higher resolution of different cell types, such as FACS sorting with antibodies to a set of specific cellular markers, may be used to obtain substantially pure populations of the desired cells.

b. Cancer Cell Engineering and Modification

The cancer cells comprised in the cancer vaccine are PTEN- and p53-deficient. In some embodiments, cancer cells are PTEN- and p53-deficient due to genetic mutations acquired by the cancer cells during cancer transformation or progression. In some other embodiments, cancer cells are engineered to become PTEN- and p53-deficient with an agent that reduces copy number, amount, and/or activity of PTEN and/or p53.

The agent that reduces copy number, amount, and/or activity of PTEN and/or p53 could be a small molecule inhibitor, CRISPR guide RNA (gRNA), RNA interfering agent, antisense oligonucleotide, peptide or peptidomimetic inhibitor, aptamer, antibody, or intrabody.

In one embodiment, peptides or peptide mimetics can be used to antagonize the activity of PTEN and/or p53. In one embodiment, variants of PTEN and/or p53 which function as a modulating agent for the respective full length protein, can be identified by screening combinatorial libraries of mutants, e.g., truncation mutants, for antagonist activity. In one embodiment, a variegated library of variants is generated by combinatorial mutagenesis at the nucleic acid level and is encoded by a variegated gene library. A variegated library of variants can be produced, for instance, by enzymatically ligating a mixture of synthetic oligonucleotides into gene sequences such that a degenerate set of potential polypeptide sequences is expressible as individual polypeptides containing the set of polypeptide sequences therein. There are a variety of methods which can be used to produce libraries of polypeptide variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential polypeptide sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of a polypeptide coding sequence can be used to generate a variegated population of polypeptide fragments for screening and subsequent selection of variants of a given polypeptide. In one embodiment, a library of coding sequence fragments can be generated by treating a double stranded PCR fragment of a polypeptide coding sequence with a nuclease under conditions wherein nicking occurs only about once per polypeptide, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the polypeptide.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of polypeptides. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique which enhances the frequency of functional mutants in the libraries, can be used in combination with the screening assays to identify variants of interest (Arkin and Youvan (1992) *Proc. Natl. Acad. Sci. USA* 89:7811-7815; Delagrave et al. (1993) *Protein Eng.* 6(3): 327-331). In one embodiment, cell based assays can be exploited to analyze a variegated polypeptide library. For example, a library of expression vectors can be transfected into a cell line which ordinarily synthesizes PTEN and/or p53. The transfected cells are then cultured such that the full length polypeptide and a particular mutant polypeptide are produced and the effect of expression of the mutant on the full length polypeptide activity in cell supernatants can be detected, e.g., by any of a number of functional assays. Plasmid DNA can then be recovered from the cells which score for inhibition, or alternatively, potentiation of full length polypeptide activity, and the individual clones further characterized.

Systematic substitution of one or more amino acids of a polypeptide amino acid sequence with a D-amino acid of the same type (e.g., D-lysine in place of L-lysine) can be used to generate more stable peptides. In addition, constrained peptides comprising a polypeptide amino acid sequence of interest or a substantially identical sequence variation can be generated by methods known in the art (Rizo and Gierasch (1992) *Annu. Rev. Biochem.* 61:387, incorporated herein by reference); for example, by adding internal cysteine residues capable of forming intramolecular disulfide bridges which cyclize the peptide.

The amino acid sequences disclosed herein will enable those of skill in the art to produce polypeptides corresponding peptide sequences and sequence variants thereof. Such polypeptides can be produced in prokaryotic or eukaryotic host cells by expression of polynucleotides encoding the peptide sequence, frequently as part of a larger polypeptide. Alternatively, such peptides can be synthesized by chemical methods. Methods for expression of heterologous proteins in recombinant hosts, chemical synthesis of polypeptides, and in vitro translation are well-known in the art and are described further in Maniatis et al. *Molecular Cloning: A Laboratory Manual* (1989), 2nd Ed., Cold Spring Harbor, N.Y.; Berger and Kimmel, Methods in Enzymology, Volume 152, *Guide to Molecular Cloning Techniques* (1987), Academic Press, Inc., San Diego, Calif.; Merrifield, J. (1969) *J. Am. Chem. Soc.* 91:501; Chaiken I. M. (1981) *CRC Crit. Rev. Biochem.* 11: 255; Kaiser et al. (1989) *Science* 243:187; Merrifield, B. (1986) *Science* 232:342; Kent, S. B. H. (1988) *Annu. Rev. Biochem.* 57:957; and Offord, R. E. (1980) *Semisynthetic Proteins*, Wiley Publishing, which are incorporated herein by reference).

Peptides can be produced, typically by direct chemical synthesis. Peptides can be produced as modified peptides, with nonpeptide moieties attached by covalent linkage to the N-terminus and/or C-terminus. In certain preferred embodiments, either the carboxy-terminus or the amino-terminus, or both, are chemically modified. The most common modifications of the terminal amino and carboxyl groups are acetylation and amidation, respectively. Amino-terminal modifications such as acylation (e.g., acetylation) or alkylation (e.g., methylation) and carboxy-terminal-modifications such as amidation, as well as other terminal modifications, including cyclization, can be incorporated into various embodiments of the invention. Certain amino-terminal and/or carboxy-terminal modifications and/or peptide extensions to the core sequence can provide advantageous physical, chemical, biochemical, and pharmacological properties, such as: enhanced stability, increased potency and/or efficacy, resistance to serum proteases, desirable pharmacokinetic properties, and others. Peptides disclosed herein can be used therapeutically to treat disease, e.g., by altering costimulation in a patient.

Peptidomimetics (Fauchere (1986) *Adv. Drug Res.* 15:29; Veber and Freidinger (1985) TINS p. 392; and Evans et al. (1987) *J. Med. Chem.* 30:1229, which are incorporated herein by reference) are usually developed with the aid of computerized molecular modeling. Peptide mimetics that are structurally similar to therapeutically useful peptides can be used to produce an equivalent therapeutic or prophylactic effect. Generally, peptidomimetics are structurally similar to a paradigm polypeptide (i.e., a polypeptide that has a biological or pharmacological activity), but have one or more peptide linkages optionally replaced by a linkage selected from the group consisting of: —CH2NH—, —$CH_2S$—, —CH2—CH2—, —CH═CH— (cis and trans), —COCH2—, —CH(OH)CH2—, and —CH2SO—, by methods known in the art and further described in the following references: Spatola, A. F. in "*Chemistry and Biochemistry of Amino Acids, Peptides, and Proteins*" Weinstein, B., ed., Marcel Dekker, New York, p. 267 (1983); Spatola, A. F., (1983) *Vega Data* Vol. 1, Issue 3, "Peptide Backbone Modifications" (general review); Morley, J. S. (1980) *Trends Pharm. Sci.* 463-468 (general review); Hudson, D. et al. (1979) *Int. J. Pept. Prot. Res.* 14:177-185 (—CH2NH—, CH2CH2—); Spatola, A. F. et at (1986) *Life Sci.* 38:1243-1249 (—CH2-S); Hann, M. M. (1982) *J. Chem. Soc. Perkin Trans. I.* 307-314 (—CH—CH—, cis and trans); Almquist, R. G. et al. (1980) *J. Med. Chem.* 23:1392-1398 (—COCH2—); Jennings-White, C. et al. (1982) *Tetrahedron Lett.* 23:2533 (—COCH2—); Szelke, M. et al. (1982) European Appln. EP 45665 CA: 97:39405 (—CH (OH)CH2—); Holladay, M. W. et at (1983) *Tetrahedron Lett.* 24:4401-4404 (—C(OH)CH2—); and Hruby, V. J. (1982) *Life Sci.* 31:189-199 (—CH2-S—); each of which is incorporated herein by reference. A particularly preferred non-peptide linkage is —CH2NH—. Such peptide mimetics may have significant advantages over polypeptide embodiments, including, for example: more economical production, greater chemical stability, enhanced pharmacological properties (half-life, absorption, potency, efficacy, etc.), altered specificity (e.g., a broad-spectrum of biological activities), reduced antigenicity, and others. Labeling of peptidomimetics usually involves covalent attachment of one or more labels, directly or through a spacer (e.g., an amide group), to non-interfering position(s) on the peptidomimetic that are predicted by quantitative structure-activity data and/or molecular modeling. Such non-interfering positions generally are positions that do not form direct contacts with the macropolypeptides(s) to which the peptidomimetic binds to produce the therapeutic effect. Derivatization (e.g., labeling) of peptidomimetics should not substantially interfere with the desired biological or pharmacological activity of the peptidomimetic.

Also encompassed by the present invention are small molecules which can modulate (e.g., inhibit) activity of PTEN and/or p53 or their interactions with their natural binding partners. The small molecules of the present invention can be obtained using any of the numerous approaches in combinatorial library methods known in the art, including: spatially addressable parallel solid phase or solution phase libraries; synthetic library methods requiring deconvolution; the 'one-bead one-compound' library method; and synthetic library methods using affinity chromatography selection. (Lam, K. S. (1997) *Anticancer Drug Des.* 12:145).

Examples of methods for the synthesis of molecular libraries can be found in the art, for example in: DeWitt et al. (1993) *Proc. Natl. Acad. Sci. USA* 90:6909; Erb et al. (1994) *Proc. Natl. Acad. Sci. USA* 91:11422; Zuckermann et al. (1994) *J. Med. Chem.* 37:2678; Cho et al (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al (1994) *J. Med. Chem.* 37:1233.

Libraries of compounds can be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner U.S. Pat. No. 5,223,409), spores (Ladner USP '409), plasmids (Cull et al. (1992) *Proc. Natl. Acad. Sci. USA* 89:1865-1869) or on phage (Scott and Smith (1990) *Science* 249:386-390); (Devlin (1990) *Science* 249:404-406); (Cwirla et al. (1990) *Proc. Natl. Acad. Sci. USA* 87:6378-6382); (Felici (1991)*J Mol. Biol.* 222:301-310); (Ladner supra.). Compounds can be screened in cell based or non-cell based assays. Compounds can be screened in pools (e.g. multiple compounds in each testing sample) or as individual compounds.

Also provided herein are compositions comprising one or more nucleic acids comprising or capable of expressing at least 1, 2, 3, 4, 5, 10, 20 or more small nucleic acids or antisense oligonucleotides or derivatives thereof, wherein said small nucleic acids or antisense oligonucleotides or derivatives thereof in a cell specifically hybridize (e.g., bind) under cellular conditions, with cellular nucleic acids (e.g., small non-coding RNAS such as miRNAs, pre-miRNAs, pri-miRNAs, miRNA*, anti-miRNA, a miRNA binding site, a variant and/or functional variant thereof, cellular mRNAs or a fragments thereof). In one embodiment, expression of the small nucleic acids or antisense oligonucleotides or derivatives thereof in a cell can inhibit expression or biological activity of cellular nucleic acids and/or proteins, e.g., by inhibiting transcription, translation and/or small nucleic acid processing of, for example, PTEN and/or p53. In one embodiment, the small nucleic acids or antisense oligonucleotides or derivatives thereof are small RNAs (e.g., microRNAs) or complements of small RNAs. In another embodiment, the small nucleic acids or antisense oligonucleotides or derivatives thereof can be single or double stranded and are at least six nucleotides in length and are less than about 1000, 900, 800, 700, 600, 500, 400, 300, 200, 100, 50, 40, 30, 25, 24, 23, 22, 21, 20, 19, 18, 17, 16, 15, or 10 nucleotides in length. In another embodiment, a composition may comprise a library of nucleic acids comprising or capable of expressing small nucleic acids or antisense oligonucleotides or derivatives thereof, or pools of said small nucleic acids or antisense oligonucleotides or derivatives thereof. A pool of nucleic acids may comprise about 2-5, 5-10, 10-20, 10-30 or more nucleic acids comprising or capable of expressing small nucleic acids or antisense oligonucleotides or derivatives thereof.

In one embodiment, binding may be by conventional base pair complementarity, or, for example, in the case of binding to DNA duplexes, through specific interactions in the major groove of the double helix. In general, "antisense" refers to the range of techniques generally employed in the art, and includes any process that relies on specific binding to oligonucleotide sequences.

It is well-known in the art that modifications can be made to the sequence of a miRNA or a pre-miRNA without disrupting miRNA activity. As used herein, the term "functional variant" of a miRNA sequence refers to an oligonucleotide sequence that varies from the natural miRNA sequence, but retains one or more functional characteristics of the miRNA (e.g. cancer cell proliferation inhibition, induction of cancer cell apoptosis, enhancement of cancer cell susceptibility to chemotherapeutic agents, specific miRNA target inhibition). In some embodiments, a functional variant of a miRNA sequence retains all of the functional characteristics of the miRNA. In certain embodiments, a functional variant of a miRNA has a nucleobase sequence that is a least about 60%, 65%, 70%, 75%, 80%, 85%, 90%, 91%, 92%, 93%, 94%, 95%, 96%, 97%, 98% or 99% identical to the miRNA or precursor thereof over a region of about 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, 95, 100 or more nucleobases, or that the functional variant hybridizes to the complement of the miRNA or precursor thereof under stringent hybridization conditions. Accordingly, in certain embodiments the nucleobase sequence of a functional variant is capable of hybridizing to one or more target sequences of the miRNA.

MicroRNAs and their corresponding stem-loop sequences described herein may be found in miRBase, an online searchable database of miRNA sequences and annotation, found on the world wide web at microrna.sanger.ac.uk. Entries in the miRBase Sequence database represent a predicted hairpin portion of a miRNA transcript (the stem-loop), with information on the location and sequence of the mature miRNA sequence. The miRNA stem-loop sequences in the database are not strictly precursor miRNAs (pre-miRNAs), and may in some instances include the pre-miRNA and some flanking sequence from the presumed primary transcript. The miRNA nucleobase sequences described herein encompass any version of the miRNA, including the sequences described in Release 10.0 of the miRBase sequence database and sequences described in any earlier Release of the miRBase sequence database. A sequence database release may result in the re-naming of certain miRNAs. A sequence database release may result in a variation of a mature miRNA sequence.

In some embodiments, miRNA sequences of the invention may be associated with a second RNA sequence that may be located on the same RNA molecule or on a separate RNA molecule as the miRNA sequence. In such cases, the miRNA sequence may be referred to as the active strand, while the second RNA sequence, which is at least partially complementary to the miRNA sequence, may be referred to as the complementary strand. The active and complementary strands are hybridized to create a double-stranded RNA that is similar to a naturally occurring miRNA precursor. The activity of a miRNA may be optimized by maximizing uptake of the active strand and minimizing uptake of the complementary strand by the miRNA protein complex that regulates gene translation. This can be done through modification and/or design of the complementary strand.

In some embodiments, the complementary strand is modified so that a chemical group other than a phosphate or hydroxyl at its 5' terminus. The presence of the 5' modification apparently eliminates uptake of the complementary strand and subsequently favors uptake of the active strand by the miRNA protein complex. The 5' modification can be any of a variety of molecules known in the art, including $NH_2$, $NHCOCH_3$, and biotin.

In another embodiment, the uptake of the complementary strand by the miRNA pathway is reduced by incorporating nucleotides with sugar modifications in the first 2-6 nucleotides of the complementary strand. It should be noted that such sugar modifications can be combined with the 5' terminal modifications described above to further enhance miRNA activities.

In some embodiments, the complementary strand is designed so that nucleotides in the 3' end of the complementary strand are not complementary to the active strand. This results in double-strand hybrid RNAs that are stable at the 3' end of the active strand but relatively unstable at the 5' end of the active strand. This difference in stability enhances the uptake of the active strand by the miRNA pathway, while reducing uptake of the complementary strand, thereby enhancing miRNA activity.

Small nucleic acid and/or antisense constructs of the methods and compositions presented herein can be delivered, for example, as an expression plasmid which, when transcribed in the cell, produces RNA which is complementary to at least a unique portion of cellular nucleic acids (e.g., small RNAs, mRNA, and/or genomic DNA). Alternatively, the small nucleic acid molecules can produce RNA which encodes mRNA, miRNA, pre-miRNA, pri-miRNA, miRNA*, anti-miRNA, or a miRNA binding site, or a variant thereof. For example, selection of plasmids suitable for expressing the miRNAs, methods for inserting nucleic acid sequences into the plasmid, and methods of delivering the recombinant plasmid to the cells of interest are within the skill in the art. See, for example, Zeng et al. (2002) *Mol. Cell* 9:1327-1333; Tuschl (2002), *Nat. Biotechnol.* 20:446-448; Brummelkamp et al. (2002) *Science* 296:550-553; Miyagishi et al. (2002) *Nat. Biotechnol.* 20:497-500; Paddison et al. (2002) *Genes Dev.* 16:948-958; Lee et al. (2002) *Nat. Biotechnol.* 20:500-505; and Paul et al. (2002) *Nat. Biotechnol.* 20:505-508, the entire disclosures of which are herein incorporated by reference.

Alternatively, small nucleic acids and/or antisense constructs are oligonucleotide probes that are generated ex vivo and which, when introduced into the cell, results in hybridization with cellular nucleic acids. Such oligonucleotide probes are preferably modified oligonucleotides that are resistant to endogenous nucleases, e.g., exonucleases and/or endonucleases, and are therefore stable in vivo. Exemplary nucleic acid molecules for use as small nucleic acids and/or antisense oligonucleotides are phosphoramidate, phosphothioate and methylphosphonate analogs of DNA (see also U.S. Pat. Nos. 5,176,996; 5,264,564; and 5,256,775). Additionally, general approaches to constructing oligomers useful in antisense therapy have been reviewed, for example, by Van der Krol et al. (1988) *BioTechniques* 6:958-976; and Stein et al. (1988) *Cancer Res* 48:2659-2668.

Antisense approaches may involve the design of oligonucleotides (either DNA or RNA) that are complementary to cellular nucleic acids (e.g., complementary to PTEN and/or p53 genes). Absolute complementarity is not required. In the case of double-stranded antisense nucleic acids, a single strand of the duplex DNA may thus be tested, or triplex formation may be assayed. The ability to hybridize will depend on both the degree of complementarity and the length of the antisense nucleic acid. Generally, the longer the hybridizing nucleic acid, the more base mismatches with a nucleic acid (e.g., RNA) it may contain and still form a stable duplex (or triplex, as the case may be). One skilled in the art can ascertain a tolerable degree of mismatch by use of standard procedures to determine the melting point of the hybridized complex.

Oligonucleotides that are complementary to the 5' end of the mRNA, e.g., the 5' untranslated sequence up to and including the AUG initiation codon, should work most efficiently at inhibiting translation. However, sequences complementary to the 3' untranslated sequences of mRNAs have recently been shown to be effective at inhibiting translation of mRNAs as well (Wagner (1994) *Nature* 372:333). Therefore, oligonucleotides complementary to either the 5' or 3' untranslated, non-coding regions of genes could be used in an antisense approach to inhibit translation of endogenous mRNAs. Oligonucleotides complementary to the 5' untranslated region of the mRNA may include the complement of the AUG start codon. Antisense oligonucleotides complementary to mRNA coding regions are less efficient inhibitors of translation but could also be used in accordance with the methods and compositions presented herein. Whether designed to hybridize to the 5', 3' or coding region of cellular mRNAs, small nucleic acids and/or antisense nucleic acids should be at least six nucleotides in length, and can be less than about 1000, 900, 800, 700, 600, 500, 400, 300, 200, 100, 50, 40, 30, 25, 24, 23, 22, 21, 20, 19, 18, 17, 16, 15, or 10 nucleotides in length.

Regardless of the choice of target sequence, it is preferred that in vitro studies are first performed to quantitate the ability of the antisense oligonucleotide to inhibit gene expression. In one embodiment these studies utilize controls that distinguish between antisense gene inhibition and nonspecific biological effects of oligonucleotides. In another embodiment these studies compare levels of the target nucleic acid or protein with that of an internal control nucleic acid or protein. Additionally, it is envisioned that results obtained using the antisense oligonucleotide are compared with those obtained using a control oligonucleotide. It is preferred that the control oligonucleotide is of approximately the same length as the test oligonucleotide and that the nucleotide sequence of the oligonucleotide differs from the antisense sequence no more than is necessary to prevent specific hybridization to the target sequence.

Small nucleic acids and/or antisense oligonucleotides can be DNA or RNA or chimeric mixtures or derivatives or modified versions thereof, single-stranded or double-stranded. Small nucleic acids and/or antisense oligonucleotides can be modified at the base moiety, sugar moiety, or phosphate backbone, for example, to improve stability of the molecule, hybridization, etc., and may include other appended groups such as peptides (e.g., for targeting host cell receptors), or agents facilitating transport across the cell membrane (see, e.g., Letsinger et al. (1989) *Proc. Natl. Acad. Sci. U.S.A.* 86:6553-6556; Lemaitre et al. (1987) *Proc. Natl. Acad. Sci. U.S.A.* 84:648-652; PCT Publication No. WO88/09810) or the blood-brain barrier (see, e.g., PCT Publication No. WO89/10134), hybridization-triggered cleavage agents. (See, e.g., Krol et al. (1988) *BioTech.* 6:958-976) or intercalating agents. (See, e.g., Zon (1988) *Pharm. Res.* 5:539-549). To this end, small nucleic acids and/or antisense oligonucleotides may be conjugated to another molecule, e.g., a peptide, hybridization triggered cross-linking agent, transport agent, hybridization-triggered cleavage agent, etc.

Small nucleic acids and/or antisense oligonucleotides may comprise at least one modified base moiety which is selected from the group including but not limited to 5-fluorouracil, 5-bromouracil, 5-chlorouracil, 5-iodouracil, hypoxanthine, xantine, 4-acetylcytosine, 5-(carboxyhydroxytiethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Small nucleic acids and/or antisense oligonucleotides may also comprise at least one modified sugar moiety selected from the group including but not limited to arabinose, 2-fluoroarabinose, xylulose, and hexose.

In certain embodiments, a compound comprises an oligonucleotide (e.g., a miRNA or miRNA encoding oligonucleotide) conjugated to one or more moieties which enhance the activity, cellular distribution or cellular uptake of the resulting oligonucleotide. In certain such embodiments, the moiety is a cholesterol moiety (e.g., antagomirs) or a lipid moiety or liposome conjugate. Additional moieties for conjugation include carbohydrates, phospholipids, biotin, phenazine, folate, phenanthridine, anthraquinone, acridine, fluoresceins, rhodamines, coumarins, and dyes. In certain embodiments, a conjugate group is attached directly to the oligonucleotide. In certain embodiments, a conjugate group is attached to the oligonucleotide by a linking moiety selected from amino, hydroxyl, carboxylic acid, thiol, unsaturations (e.g., double or triple bonds), 8-amino-3,6-dioxaoctanoic acid (ADO), succinimidyl 4-(N-maleimidomethyl) cyclohexane-1-carboxylate (SMCC), 6-aminohexanoic acid (AHEX or AHA), substituted C1-C10 alkyl, substituted or unsubstituted C2-C10 alkenyl, and substituted or unsubstituted C2-C10 alkynyl. In certain such embodiments, a substituent group is selected from hydroxyl, amino, alkoxy, carboxy, benzyl, phenyl, nitro, thiol, thioalkoxy, halogen, alkyl, aryl, alkenyl and alkynyl.

In certain such embodiments, the compound comprises the oligonucleotide having one or more stabilizing groups that are attached to one or both termini of the oligonucleotide to enhance properties such as, for example, nuclease stability. Included in stabilizing groups are cap structures. These terminal modifications protect the oligonucleotide from exonuclease degradation, and can help in delivery and/or localization within a cell. The cap can be present at the 5'-terminus (5'-cap), or at the 3'-terminus (3'-cap), or can be present on both termini. Cap structures include, for example, inverted deoxy abasic caps.

Suitable cap structures include a 4',5'-methylene nucleotide, a 1-(beta-D-erythrofuranosyl) nucleotide, a 4'-thio nucleotide, a carbocyclic nucleotide, a 1,5-anhydrohexitol nucleotide, an L-nucleotide, an alpha-nucleotide, a modified base nucleotide, a phosphorodithioate linkage, a threo-pentofuranosyl nucleotide, an acyclic 3',4'-seco nucleotide, an acyclic 3,4-dihydroxybutyl nucleotide, an acyclic 3,5-dihydroxypentyl nucleotide, a 3'-3'-inverted nucleotide moiety, a 3'-3'-inverted abasic moiety, a 3'-2'-inverted nucleotide moiety, a 3'-2'-inverted abasic moiety, a 1,4-butanediol phosphate, a 3'-phosphoramidate, a hexylphosphate, an aminohexyl phosphate, a 3'-phosphate, a 3'-phosphorothioate, a phosphorodithioate, a bridging methylphosphonate moiety, and a non-bridging methylphosphonate moiety 5'-aminoalkyl phosphate, a 1,3-diamino-2-propyl phosphate, 3-aminopropyl phosphate, a 6-aminohexyl phosphate, a 1,2-aminododecyl phosphate, a hydroxypropyl phosphate, a 5'-5'-inverted nucleotide moiety, a 5'-5'-inverted abasic moiety, a 5'-phosphoramidate, a 5'-phosphorothioate, a 5'-amino, a bridging and/or non-bridging 5'-phosphoramidate, a phosphorothioate, and a 5'-mercapto moiety.

Small nucleic acids and/or antisense oligonucleotides can also contain a neutral peptide-like backbone. Such molecules are termed peptide nucleic acid (PNA)-oligomers and are described, e.g., in Perry-O'Keefe et al. (1996) *Proc. Natl. Acad. Sci. U.S.A.* 93:14670 and in Eglom et al. (1993) *Nature* 365:566. One advantage of PNA oligomers is their capability to bind to complementary DNA essentially independently from the ionic strength of the medium due to the neutral backbone of the DNA. In yet another embodiment, small nucleic acids and/or antisense oligonucleotides comprises at least one modified phosphate backbone selected from the group consisting of a phosphorothioate, a phosphorodithioate, a phosphoramidothioate, a phosphoramidate, a phosphordiamidate, a methylphosphonate, an alkyl phosphotriester, and a formacetal or analog thereof.

In a further embodiment, small nucleic acids and/or antisense oligonucleotides are $\alpha$-anomeric oligonucleotides. An $\alpha$-anomeric oligonucleotide forms specific double-stranded hybrids with complementary RNA in which, contrary to the usual b-units, the strands run parallel to each other (Gautier et al. (1987) *Nucl. Acids Res.* 15:6625-6641). The oligonucleotide is a 2'-O-methylribonucleotide (Inoue et al. (1987) *Nucl. Acids Res.* 15:6131-6148), or a chimeric RNA-DNA analogue (Inoue et al. (1987) *FEBS Lett.* 215: 327-330).

Small nucleic acids and/or antisense oligonucleotides of the methods and compositions presented herein may be synthesized by standard methods known in the art, e.g., by use of an automated DNA synthesizer (such as are commercially available from Biosearch, Applied Biosystems, etc.). As examples, phosphorothioate oligonucleotides may be synthesized by the method of Stein et al. (1988) *Nucl. Acids Res.* 16:3209, methylphosphonate oligonucleotides can be prepared by use of controlled pore glass polymer supports (Sarin et al. (1988) *Proc. Natl. Acad. Sci. U.S.A.* 85:7448-7451), etc. For example, an isolated miRNA can be chemically synthesized or recombinantly produced using methods known in the art. In some instances, miRNA are chemically synthesized using appropriately protected ribonucleoside phosphoramidites and a conventional DNA/RNA synthesizer. Commercial suppliers of synthetic RNA molecules or synthesis reagents include, e.g., Proligo (Hamburg, Germany), Dharmacon Research (Lafayette, Colo., USA), Pierce Chemical (part of Perbio Science, Rockford, Ill., USA), Glen Research (Sterling, Va., USA), ChemGenes (Ashland, Mass., USA), Cruachem (Glasgow, UK), and Exiqon (Vedbaek, Denmark).

Small nucleic acids and/or antisense oligonucleotides can be delivered to cells in vivo. A number of methods have been developed for delivering small nucleic acids and/or antisense oligonucleotides DNA or RNA to cells; e.g., antisense molecules can be injected directly into the tissue site, or modified antisense molecules, designed to target the desired cells (e.g., antisense linked to peptides or antibodies that specifically bind receptors or antigens expressed on the target cell surface) can be administered systematically.

In one embodiment, small nucleic acids and/or antisense oligonucleotides may comprise or be generated from double stranded small interfering RNAs (siRNAs), in which sequences fully complementary to cellular nucleic acids (e.g. mRNAs) sequences mediate degradation or in which sequences incompletely complementary to cellular nucleic acids (e.g., mRNAs) mediate translational repression when expressed within cells. In another embodiment, double stranded siRNAs can be processed into single stranded antisense RNAs that bind single stranded cellular RNAs (e.g., microRNAs) and inhibit their expression. RNA interference (RNAi) is the process of sequence-specific, post-transcriptional gene silencing in animals and plants, initiated by double-stranded RNA (dsRNA) that is homologous in sequence to the silenced gene. In vivo, long dsRNA is cleaved by ribonuclease III to generate 21- and 22-nucleotide siRNAs. It has been shown that 21-nucleotide siRNA duplexes specifically suppress expression of endogenous and heterologous genes in different mammalian cell lines, including human embryonic kidney (293) and HeLa cells (Elbashir et al. (2001) *Nature* 411:494-498). Accordingly, translation of a gene in a cell can be inhibited by contacting the cell with short double stranded RNAs having a length of about 15 to 30 nucleotides or of about 18 to 21 nucleotides or of about 19 to 21 nucleotides. Alternatively, a vector encoding for such siRNAs or short hairpin RNAs (shRNAs) that are metabolized into siRNAs can be introduced into a target cell (see, e.g., McManus et al (2002) *RNA* 8:842; Xia et al. (2002) *Nature Biotechnology* 20:1006; and Brummelkamp et al. (2002) *Science* 296:550). Vectors that can be used are commercially available, e.g., from OligoEngine under the name pSuper RNAi System™.

Ribozyme molecules designed to catalytically cleave cellular mRNA transcripts can also be used to prevent translation of cellular mRNAs and expression of cellular polypeptides, or both (See, e.g., PCT International Publication WO90/11364, published Oct. 4, 1990; Sarver et al. (1990) *Science* 247:1222-1225 and U.S. Pat. No. 5,093,246). While ribozymes that cleave mRNA at site-specific recognition sequences can be used to destroy cellular mRNAs, the use of hammerhead ribozymes is preferred. Hammerhead ribozymes cleave mRNAs at locations dictated by flanking regions that form complementary base pairs with the target mRNA. The sole requirement is that the target mRNA have the following sequence of two bases: 5'-UG-3' The construction and production of hammerhead ribozymes is well-known in the art and is described more fully in Haseloff and Gerlach (1988) Nature 334:585-591. The ribozyme may be engineered so that the cleavage recognition site is located near the 5' end of cellular mRNAs; i.e., to increase efficiency and minimize the intracellular accumulation of non-functional mRNA transcripts.

The ribozymes of the methods presented herein also include RNA endoribonucleases (hereinafter "Cech-type ribozymes") such as the one which occurs naturally in *Tetrahymena thermophila* (known as the IVS, or L-19 IVS RNA) and which has been extensively described by Thomas Cech and collaborators (Zaug et al. (1984) *Science* 224:574-578; Zaug et al. (1986) *Science* 231:470-475; Zaug et al. (1986) *Nature* 324:429-433; WO 88/04300; and Been et al. (1986) *Cell* 47:207-216). The Cech-type ribozymes have an eight base pair active site which hybridizes to a target RNA sequence whereafter cleavage of the target RNA takes place. The methods and compositions presented herein encompasses those Cech-type ribozymes which target eight base-pair active site sequences that are present in cellular genes.

As in the antisense approach, the ribozymes can be composed of modified oligonucleotides (e.g., for improved stability, targeting, etc.). A preferred method of delivery involves using a DNA construct "encoding" the ribozyme under the control of a strong constitutive pol III or pol II promoter, so that transfected cells will produce sufficient quantities of the ribozyme to destroy endogenous cellular messages and inhibit translation. Because ribozymes unlike antisense molecules, are catalytic, a lower intracellular concentration is required for efficiency.

Nucleic acid molecules to be used in triple helix formation for the inhibition of transcription of cellular genes are preferably single stranded and composed of deoxyribonucleotides. The base composition of these oligonucleotides should promote triple helix formation via Hoogsteen base pairing rules, which generally require sizable stretches of either purines or pyrimidines to be present on one strand of a duplex. Nucleotide sequences may be pyrimidine-based, which will result in TAT and CGC triplets across the three associated strands of the resulting triple helix. The pyrimidine-rich molecules provide base complementarity to a purine-rich region of a single strand of the duplex in a parallel orientation to that strand. In addition, nucleic acid molecules may be chosen that are purine-rich, for example, containing a stretch of G residues. These molecules will form a triple helix with a DNA duplex that is rich in GC pairs, in which the majority of the purine residues are located on a single strand of the targeted duplex, resulting in CGC triplets across the three strands in the triplex.

Alternatively, the potential sequences that can be targeted for triple helix formation may be increased by creating a so-called "switchback" nucleic acid molecule. Switchback molecules are synthesized in an alternating 5'-3', 3'-5' manner, such that they base pair with first one strand of a duplex and then the other, eliminating the necessity for a sizable stretch of either purines or pyrimidines to be present on one strand of a duplex.

Small nucleic acids (e.g., miRNAs, pre-miRNAs, pri-miRNAs, miRNA*, anti-miRNA, or a miRNA binding site, or a variant thereof), antisense oligonucleotides, ribozymes, and triple helix molecules of the methods and compositions presented herein may be prepared by any method known in the art for the synthesis of DNA and RNA molecules. These include techniques for chemically synthesizing oligodeoxyribonucleotides and oligoribonucleotides well-known in the art such as for example solid phase phosphoramidite chemical synthesis. Alternatively, RNA molecules may be generated by in vitro and in vivo transcription of DNA sequences encoding the antisense RNA molecule. Such DNA sequences may be incorporated into a wide variety of vectors which incorporate suitable RNA polymerase promoters such as the T7 or SP6 polymerase promoters. Alternatively, antisense cDNA constructs that synthesize antisense RNA constitutively or inducibly, depending on the promoter used, can be introduced stably into cell lines.

Moreover, various well-known modifications to nucleic acid molecules may be introduced as a means of increasing intracellular stability and half-life. Possible modifications include but are not limited to the addition of flanking sequences of ribonucleotides or deoxyribonucleotides to the 5' and/or 3' ends of the molecule or the use of phosphorothioate or 2' O-methyl rather than phosphodiesterase linkages within the oligodeoxyribonucleotide backbone. One of skill in the art will readily understand that polypeptides, small nucleic acids, and antisense oligonucleotides can be further linked to another peptide or polypeptide (e.g., a heterologous peptide), e.g., that serves as a means of protein detection. Non-limiting examples of label peptide or polypeptide moieties useful for detection in the invention include, without limitation, suitable enzymes such as horseradish peroxidase, alkaline phosphatase, beta-galactosidase, or acetylcholinesterase; epitope tags, such as FLAG, MYC, HA, or HIS tags; fluorophores such as green fluorescent protein; dyes; radioisotopes; digoxygenin; biotin; antibodies; polymers; as well as others known in the art, for example, in *Principles of Fluorescence Spectroscopy*, Joseph R. Lakowicz (Editor), Plenum Pub Corp, 2nd edition (July 1999).

The present invention also contemplates well-known methods for genetically modifying the genome of an organism or cell to modify the expression and/or activity of PTEN and/or p53 without contacting the organism or cell with agent once the genetic modification has been completed. For example, cancer cells can be genetically modified using recombinant techniques in order to modulate the expression and/or activity of PTEN and/or p53, such that no agent needs to contact the cancer cells in order for the expression and/or activity PTEN and/or p53 to be modulated. For example, targeted or untargeted gene knockout methods can be used, such as to recombinantly engineer subject cancer cell ex vivo prior to infusion into the subject. For example, the target DNA in the genome can be manipulated by deletion, insertion, and/or mutation using retroviral insertion, artificial chromosome techniques, gene insertion, random insertion with tissue specific promoters, gene targeting, transposable elements and/or any other method for introducing foreign DNA or producing modified DNA/modified nuclear DNA. Other modification techniques include deleting DNA sequences from a genome and/or altering nuclear DNA sequences. Nuclear DNA sequences, for example, may be altered by site-directed mutagenesis. Such methods generally use host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein. Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals. For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die).

Similarly, the CRISPR-Cas system can be used for precise editing of genomic nucleic acids (e.g., for creating null mutations). In such embodiments, the CRISPR guide RNA and/or the Cas enzyme may be expressed. For example, a vector containing only the guide RNA can be administered to an animal or cells transgenic for the Cas9 enzyme. Similar strategies may be used (e.g., designer zinc finger, transcription activator-like effectors (TALEs) or homing meganucleases). Such systems are well-known in the art (see, for example, U.S. Pat. No. 8,697,359; Sander and Joung (2014) *Nat. Biotech.* 32:347-355; Hale et al. (2009) *Cell* 139:945-956; Karginov and Hannon (2010) *Mol. Cell* 37:7; U.S. Pat. Publ. 2014/0087426 and 2012/0178169; Boch et al. (2011) *Nat. Biotech.* 29:135-136; Boch et al. (2009) *Science* 326:1509-1512; Moscou and Bogdanove (2009) *Science* 326:1501; Weber et al. (2011) *PLoS One* 6:e19722; Li et al. (2011) *Nucl. Acids Res.* 39:6315-6325; Zhang et al. (2011) *Nat. Biotech.* 29:149-153; Miller et al. (2011) *Nat. Biotech.* 29:143-148; Lin et al. (2014) *Nucl. Acids Res.* 42:e47). Such genetic strategies can use constitutive expression systems or inducible expression systems according to well-known methods in the art.

In some embodiments, the cancer cells are non-replicative. In certain embodiments, the cancer cells are non-replicative due to irradiation (e.g., $\gamma$ and/or UV irradiation), and/or administration of an agent rendering cell replication incompetent (e.g., compounds that disrupt the cell membrane, inhibitors of DNA replication, inhibitors of spindle formation during cell division, etc.). Typically a minimum dose of about 3500 rads radiation is sufficient, although doses up to about 30,000 rads are acceptable. In some embodiments, a sub-lethal dose of irradiation may be used. For example, the cancer cells may be irradiated to suppress cell proliferation before administration of the cancer vaccine to reduce the risk of giving rise to new neoplastic lesions. It is understood that irradiation is only one way to render the cells non-replicative, and that other methods which result in cancer cells incapable of cell division but that retain the ability to to trigger the antitumor immunity upon activation of the TGFβ-Smad/p63 signaling pathway are included in the present invention.

c. Agents that Activate TGFβ-Smad/p63 Signaling Pathway

It is demonstrated herein that activation of TGFβ-Smad/p63 axis in cancer cells regulates expression of multiple pathways that promote immune respons and ultimately activation of cytotoxic T cells and immunological memory. Thus, the cancer cells encompassed by the present invention described herein are modified to activate TGFβ-Smad/p63 signaling pathway. In one embodiments, the cancer cells are contacted with a TGFβ superfamily protein to activate TGFβ-Smad/p63 signaling pathway. In another embodiment, the cancer cells are contacted with a modulator of the copy number, the expression, and/or the activity of one or more biomarkers listed in Table 1 that can activate TGFβ-Smad/p63 signaling pathway. The cancer cells (e.g., cancer cell lines or tumor tissues) can be cultured in 2D or 3D (e.g., cultured as tumorspheres or organoids) in vitro or ex vivo.

In some embodiments, cancer vaccine comprising the modified cancer cells described herein may be tested for certain desired characteristics or functions prior to administration into a subject. In one embodiment, the loss of PTEN and p53 is confirmed in the modified cancer cells. In another embodiment, the activation of the TGFβ-Smad/p63 signaling pathway is detected in the modified cancer cells. In still another embodiment, the modified cancer cells are tested for one or more of the following properties:

a) reduced grow rate in either a 2D- or 3D-culture system;
b) activation of the TGFβ-Smad/p63 signatures, such as upregulation of ICOSL, PYCARD, SFN, PERP, RIPK3, CASP9, and/or SESN1; and/or downregulation of KSR1, EIF4EBP1, ITGA5, EMILIN1, CD200, and/or CSF1;
c) upregulation of one or more dendritic cells (DCs) activation markers, which include but are not limited to, CD40, CD80, CD86, CD8, HLA-DR, IL1-beta, etc.; and/or
d) activation of T cells in the presence of DCs, such as increasing the secretion of TNFα and/or IFNγ by T cells in the presence of DCs.

i. TGFβ Superfamily Proteins

In one embodiment, PTEN- and p53-deficient cancer cells described herein are contacted with a TGFβ superfamily protein to activate the TGFβ-Smad/p63 signaling pathway. The TGFβ superfamily protein can be any member of the TGFβ superfamily that is capable of activating the TGFβ-Smad/p63 signaling pathway. The TGFβ superfamily protein may be from the TGFβ family, which includes but is not limitated to, LAP, TGFβ1, TGFβ2, TGFβ3, and TGFβ5. The TGFβ superfamily protein may be from the Activin family, which includes but is not limitated to, Activin A, Activin AB, Activin AC, Activin B, Activin C, C17ORF99, INHBA, INHBB, Inhibin, Inhibin A, and Inhibin B. The TGFβ superfamily protein may be from the BMP (Bone Morphogenetic Protein) family, BMP-1/PCP, BMP-2, BMP-2/BMP-6 Heterodimer, BMP-2/BMP-7 Heterodimer, BMP-2a, BMP-3, BMP-3b/GDF-10, BMP-4, BMP-4/BMP-7 Heterodimer, BMP-5, BMP-6, BMP-7, BMP-8, BMP-8a, BMP-8b, BMP-9, BMP-10, BMP-15/GDF-9B, and Decapentaplegic/DPP. The TGFβ superfamily protein may be from the GDNF Family, Artemin, GDNF, Neurturin, and Persephin. The TGFβ superfamily protein may be from a family other than the ones listed above, which includes but is not limitated to, Lefty A, Lefty B, MIS/AMH, Nodal, and SCUBE3. In certain embodiments, the TGFβ superfamily protein is TGFβ1, TGFβ2 and/or TGFβ3. In one embodiment, the cancer cells are contacted with a single TGFβ superfamily protein (e.g., TGFβ1, TGFβ2, or TGFβ3). In another embodiment, the cancer cells are contacted with a combination of TGFβ superfamily proteins (e.g., a combination of TGFβ1, TGFβ2 and TGFβ3).

The cancer cells may be contacted with a TGFβ superfamily protein alone in vitro, in vivo, and/or ex vivo. In one embodiment, the cancer cells are contacted with a TGFβ superfamily protein in vitro or ex vivo, and then the cancer cells are administered to a subject without administration of the TGFβ superfamily protein to the subject in vivo. In another embodiment, the cancer cells are administered to a subject, wherein the TGFβ superfamily protein is administered to the subject to thereby contact the cancer cells in vivo. In still another embodiment, the cancer cells are contacted with a TGFβ superfamily protein in vitro or ex vivo, and then the cancer cells are administered to a subject with administration of the TGFβ superfamily protein to the subject in vivo. The TGFβ superfamily protein may be administered to the subject before, after, and/or concurrently with administration of the cancer cells. In some embodiments, the cancer cells are contacted with the TGFβ superfamily protein in combination with an immune checkpoint blockade in vitro, in vivo, and/or ex vivo. The subject may be administered with an immune checkpoint blockade before, after, and/or concurrently with administration of the cancer vaccine.

The dosage of the TGFβ superfamily protein may be varied so as to obtain an amount of the activation of TGFβ-Smad/p63 signaling pathway which is effective to achieve the desired therapeutic response for a particular patient, composition, and mode of administration, without being toxic to the patient.

The selected dosage level will depend upon a variety of factors including the activity of the particular TGFβ superfamily protein employed, the specific type of cancer cells to be contacted with, the route of administration, the time of administration, the rate of excretion or metabolism of the particular TGFβ superfamily protein being employed, the duration of the treatment, other drugs, compounds and/or materials used in combination with the particular TGFβ superfamily protein employed, the age, sex, weight, condition, general health and prior medical history of the patient being treated with the cancer vaccine, and like factors well known in the medical arts.

In some embodiments, the cancer cells are contacted with a TGFβ superfamily protein at a dosage more than 0.1 ng/ml, such as more than 0.2 ng/ml, more than 0.3 ng/ml, more than 0.4 ng/ml, more than 0.5 ng/ml, more than 0.6 ng/ml, more than 0.7 ng/ml, more than 0.8 ng/ml, more than 0.9 ng/ml, more than 1 ng/ml, more than 1.5 ng/ml, more than 2 ng/ml, more than 2.5 ng/ml, more than 3 ng/ml, more than 3.5 ng/ml, more than 4 ng/ml, more than 4.5 ng/ml, more than 5 ng/ml, more than 5.5 ng/ml, more than 6 ng/ml, more than 6.5 ng/ml, more than 7 ng/ml, more than 7.5 ng/ml, more than 8 ng/ml, more than 8.5 ng/ml, more than 9 ng/ml, more than 9.5 ng/ml, more than 10 ng/ml, etc.

In some embodiments, the cancer cells are contacted with a TGFβ superfamily protein at a dosage from about 0.1 ng/ml to about 100 ng/ml. In preferred embodiments, the cancer cells are contacted with a TGFβ superfamily protein at a dosage from about 1 ng/ml to about 10 ng/ml, such as about 1 ng/ml, 1.5 ng/ml, 2 ng/ml, 2.5 ng/ml, 3 ng/ml, 3.5 ng/ml, 4 ng/ml, 4.5 ng/ml, 5 ng/ml, 5.5 ng/ml, 6 ng/ml, 6.5 ng/ml, 7 ng/ml, 7.5 ng/ml, 8 ng/ml, 8.5 ng/ml, 9 ng/ml, 9.5 ng/ml, or 10 ng/ml or any value in between.

In some embodiments, the cancer cells are contacted with a TGFβ superfamily protein for a period of time. The period of time may be from minutes to 4 weeks, such as 10 min, 30 min, 1 hour, 3 hours, 6 hours, 9 hours, 12 hours, 15 hours, 18 hours, 21 hours, 24 hours, 36 hours, 2 days, 2.5 days, 3 days, 3.5 days, 4 days, 4.5 days, 5 days, 5.5 days, 6 days, 6.5 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, or 28 days or any value in between. Preferred ranges of the period of time are from about 6 hours to about 21 days, from about 12 hours to about 15 days, from about 1 day to about 10 days, or from about 3 days to about 7 days.

ii. Agents that Increase the Copy Number, Amount, and/or Activity of at Least One Biomarker Listed in Table 1

In another embodiment, the PTNE- and p53-deficient cancer cells described herein are contacted with a modulator of the copy number, the expression, and/or the activity of one or more biomarkers listed in Table 1 and thereby activate the TGFβ-Smad/p63 signaling pathway. Agents that increase the copy number, the expression, and/or the activity of one or more biomarkers listed in Table 1 can do so either directly or indirectly.

Agents useful in the methods encompassed by the present invention include antibodies, small molecules, peptides, peptidomimetics, natural ligands, derivatives of natural ligands, etc. that can bind and/or modulate one or more biomarkers listed in Table 1, or fragments thereof; RNA interference, antisense, nucleic acid aptamers, nucleic acid, polypeptide, etc. that can increase the expression and/or activity of one or more biomarkers listed in Table 1, or fragments thereof.

In one embodiment, isolated nucleic acid molecules that specifically hybridize with or encode one or more biomarkers listed in Table 1 or biologically active portions thereof. As used herein, the term “nucleic acid molecule” is intended to include DNA molecules (i.e., cDNA or genomic DNA) and RNA molecules (i.e., mRNA) and analogs of the DNA or RNA generated using nucleotide analogs. The nucleic acid molecule can be single-stranded or double-stranded, but preferably is double-stranded DNA. An “isolated” nucleic acid molecule is one which is separated from other nucleic acid molecules which are present in the natural source of the nucleic acid. Preferably, an “isolated” nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated nucleic acid molecules corresponding to one or more biomarkers listed in Table 1 can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (i.e., a lymphoma cell). Moreover, an “isolated” nucleic acid molecule, such as a cDNA molecule, can be substantially free of other cellular material, or culture medium when produced by recombinant techniques, or chemical precursors or other chemicals when chemically synthesized.

A nucleic acid molecule encompassed by the present invention, e.g., a nucleic acid molecule having the nucleotide sequence of one or more biomarkers listed in Table 1 or a nucleotide sequence which is at least about 50%, preferably at least about 60%, more preferably at least about 70%, yet more preferably at least about 80%, still more preferably at least about 90%, and most preferably at least about 95% or more (e.g., about 98%) homologous to the nucleotide sequence of one or more biomarkers listed in Table 1 or a portion thereof (i.e., 100, 200, 300, 400, 450, 500, or more nucleotides), can be isolated using standard molecular biology techniques and the sequence information provided herein. For example, a human cDNA can be isolated from a human cell line (from Stratagene, LaJolla, California, or Clontech, Palo Alto, CA) using all or portion of the nucleic acid molecule, or fragment thereof, as a hybridization probe and standard hybridization techniques (i.e., as described in Sambrook, J., Fritsh, E. F., and Maniatis, T. *Molecular Cloning: A Laboratory Manual. 2nd, ed., Cold Spring Harbor Laboratory*, Cold Spring Harbor Laboratory Press, Cold Spring Harbor, N.Y., 1989). Moreover, a nucleic acid molecule encompassing all or a portion of the nucleotide sequence of one or more biomarkers listed in Table 1 or a nucleotide sequence which is at least about 50%, preferably at least about 60%, more preferably at least about 70%, yet more preferably at least about 80%, still more preferably at least about 90%, and most preferably at least about 95% or more homologous to the nucleotide sequence, or fragment thereof, can be isolated by the polymerase chain reaction using oligonucleotide primers designed based upon one or more biomarkers listed in Table 1, or fragment thereof, or the homologous nucleotide sequence. For example, mRNA can be isolated from muscle cells (i.e., by the guanidinium-thiocyanate extraction procedure of Chirgwin et al. (1979) *Biochemistry* 18: 5294-5299) and cDNA can be prepared using reverse transcriptase (i.e., Moloney MLV reverse transcriptase, available from Gibco/BRL, Bethesda, MD; or AMV reverse transcriptase, available from Seikagaku America, Inc., St. Petersburg, FL). Synthetic oligonucleotide primers for PCR amplification can be designed according to well-known methods in the art. A nucleic acid encompassed by the present invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to the nucleotide sequence of one or more biomarkers listed in Table 1 can be prepared by standard synthetic techniques, i.e., using an automated DNA synthesizer.

Probes based on the nucleotide sequences of one or more biomarkers listed in Table 1 can be used to detect or confirm the desired transcripts or genomic sequences encoding the same or homologous proteins. In preferred embodiments, the probe further comprises a label group attached thereto, i.e., the label group can be a radioisotope, a fluorescent compound, an enzyme, or an enzyme co-factor. Such probes can be used as a part of a diagnostic test kit for identifying cells or tissue which express one or more biomarkers listed in Table 1, such as by measuring a level of nucleic acid of one or more biomarkers listed in Table 1 in a sample of cells from a subject, i.e., detecting mRNA levels of one or more biomarkers listed in Table 1.

Nucleic acid molecules encoding proteins corresponding to one or more biomarkers listed in Table 1 from different species are also contemplated. For example, rat or monkey cDNA can be identified based on the nucleotide sequence of a human and/or mouse sequence and such sequences are well-known in the art. In one embodiment, the nucleic acid molecule(s) encompassed by the present invention encodes a protein or portion thereof which includes an amino acid sequence which is sufficiently homologous to an amino acid sequence of one or more biomarkers listed in Table 1, such that the protein or portion thereof modulates (e.g., enhance), one or more of the following biological activities: a) binding to the biomarker; b) modulating the copy number of the biomarker; c) modulating the expression level of the biomarker; and d) modulating the activity level of the biomarker.

As used herein, the language "sufficiently homologous" refers to proteins or portions thereof which have amino acid sequences which include a minimum number of identical or equivalent (e.g., an amino acid residue which has a similar side chain as an amino acid residue in one or more biomarkers listed in Table 1, or fragment thereof) amino acid residues to an amino acid sequence of the biomarker, or fragment thereof, such that the protein or portion thereof modulates (e.g., enhance) one or more of the following biological activities: a) binding to the biomarker; b) modulating the copy number of the biomarker; c) modulating the expression level of the biomarker; and d) modulating the activity level of the biomarker.

In another embodiment, the protein is at least about 30%, preferably at least about 60%, more preferably at least about 70%, 75%, 80%, 85%, 90%, 91%, 92%, 93%, 94%, 95%, 96%, 97%, 98%, 99% or more homologous to the entire amino acid sequence of the biomarker, or a fragment thereof.

Portions of proteins encoded by nucleic acid molecules of one or more biomarkers listed in Table 1 are preferably biologically active portions of the protein. As used herein, the term "biologically active portion" of one or more biomarkers listed in Table 1 is intended to include a portion, e.g., a domain/motif, that has one or more of the biological activities of the full-length protein.

Standard binding assays, e.g., immunoprecipitations and yeast two-hybrid assays, as described herein, or functional assays, e.g., RNAi or overexpression experiments, can be performed to determine the ability of the protein or a biologically active fragment thereof to maintain a biological activity of the full-length protein.

The invention further encompasses nucleic acid molecules that differ from the nucleotide sequence of one or more biomarkers listed in Table 1, or fragment thereof due to degeneracy of the genetic code and thus encode the same protein as that encoded by the nucleotide sequence, or fragment thereof. In another embodiment, an isolated nucleic acid molecule encompassed by the present invention has a nucleotide sequence encoding a protein having an amino acid sequence of one or more biomarkers listed in Table 1, or fragment thereof, or a protein having an amino acid sequence which is at least about 70%, 75%, 80%, 85%, 90%, 91%, 92%, 93%, 94%, 95%, 96%, 97%, 98%, 99% or more homologous to the amino acid sequence of one or more biomarkers listed in Table 1, or fragment thereof. In another embodiment, a nucleic acid encoding a polypeptide consists of nucleic acid sequence encoding a portion of a full-length fragment of interest that is less than 195, 190, 185, 180, 175, 170, 165, 160, 155, 150, 145, 140, 135, 130, 125, 120, 115, 110, 105, 100, 95, 90, 85, 80, 75, or 70 amino acids in length.

It will be appreciated by those skilled in the art that DNA sequence polymorphisms that lead to changes in the amino acid sequences of one or more biomarkers listed in Table 1 may exist within a population (e.g., a mammalian and/or human population). Such genetic polymorphisms may exist among individuals within a population due to natural allelic variation. As used herein, the terms "gene" and "recombinant gene" refer to nucleic acid molecules comprising an open reading frame encoding one or more biomarkers listed in Table 1, preferably a mammalian, e.g., human, protein. Such natural allelic variations can typically result in 1-5% variance in the nucleotide sequence of one or more biomarkers listed in Table 1. Any and all such nucleotide variations and resulting amino acid polymorphisms in one or more biomarkers listed in Table 1 that are the result of natural allelic variation and that do not alter the functional activity of one or more biomarkers listed in Table 1 are intended to be within the scope encompassed by the present invention. Moreover, nucleic acid molecules encoding proteins of one or more biomarkers listed in Table 1 from other species.

In addition to naturally-occurring allelic variants of one or more biomarkers listed in Table 1 that may exist in the population, the skilled artisan will further appreciate that changes can be introduced by mutation into the nucleotide sequence, or fragment thereof, thereby leading to changes in the amino acid sequence of the encoded one or more biomarkers listed in Table 1, without altering the functional ability of one or more biomarkers listed in Table 1. For example, nucleotide substitutions leading to amino acid substitutions at "non-essential" amino acid residues can be made in the sequence, or fragment thereof. A "non-essential" amino acid residue is a residue that can be altered from the wild-type sequence of one or more biomarkers listed in Table 1 without altering the activity of one or more biomarkers listed in Table 1, whereas an "essential" amino acid residue is required for the activity of one or more biomarkers listed in Table 1. Other amino acid residues, however, (e.g., those that are not conserved or only semi-conserved between mouse and human) may not be essential for activity and thus are likely to be amenable to alteration without altering the activity of one or more biomarkers listed in Table 1.

The term "sequence identity or homology" refers to the sequence similarity between two polypeptide molecules or between two nucleic acid molecules. When a position in both of the two compared sequences is occupied by the same base or amino acid monomer subunit, e.g., if a position in each of two DNA molecules is occupied by adenine, then the molecules are homologous or sequence identical at that position. The percent of homology or sequence identity between two sequences is a function of the number of matching or homologous identical positions shared by the two sequences divided by the number of positions compared ×100. For example, if 6 of 10, of the positions in two sequences are the same then the two sequences are 60% homologous or have 60% sequence identity. By way of example, the DNA sequences ATTGCC and TATGGC share 50% homology or sequence identity. Generally, a comparison is made when two sequences are aligned to give maximum homology. Unless otherwise specified "loop out regions", e.g., those arising from, from deletions or insertions in one of the sequences are counted as mismatches.

The comparison of sequences and determination of percent homology between two sequences can be accomplished using a mathematical algorithm. Preferably, the alignment can be performed using the Clustal Method. Multiple alignment parameters include GAP Penalty=10, Gap Length Penalty=10. For DNA alignments, the pairwise alignment parameters can be Htuple=2, Gap penalty=5, Window=4, and Diagonal saved=4. For protein alignments, the pairwise alignment parameters can be Ktuple=1, Gap penalty=3, Window=5, and Diagonals Saved=5.

In a preferred embodiment, the percent identity between two amino acid sequences is determined using the Needleman and Wunsch (*J. Mol. Biol.* (48):444-453 (1970)) algorithm which has been incorporated into the GAP program in the GCG software package (available online), using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (available online), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Meyers and W. Miller (*CABIOS,* 4:11-17 (1989)) which has been incorporated into the ALIGN program (version 2.0) (available online), using a PAM120 weight residue table, a gap length penalty of 12 and a gap penalty of 4.

An isolated nucleic acid molecule encoding a protein homologous to one or more biomarkers listed in Table 1, or fragment thereof, can be created by introducing one or more nucleotide substitutions, additions or deletions into the nucleotide sequence, or fragment thereof, or a homologous nucleotide sequence such that one or more amino acid substitutions, additions or deletions are introduced into the encoded protein. Mutations can be introduced by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), branched side chains (e.g., threonine, valine, isoleucine) and aromatic side chains (e.g., tyrosine, phenylalanine, tryptophan, histidine). Thus, a predicted nonessential amino acid residue in one or more biomarkers listed in Table 1 is preferably replaced with another amino acid residue from the same side chain family. Alternatively, in another embodiment, mutations can be introduced randomly along all or part of the coding sequence of one or more biomarkers listed in Table 1, such as by saturation mutagenesis, and the resultant mutants can be screened for an activity described herein to identify mutants that retain desired activity. Following mutagenesis, the encoded protein can be expressed recombinantly according to well-known methods in the art and the activity of the protein can be determined using, for example, assays described herein.

The levels of one or more biomarkers listed in Table 1 may be assessed by any of a wide variety of well-known methods for detecting expression of a transcribed molecule or protein. Non-limiting examples of such methods include immunological methods for detection of proteins, protein purification methods, protein function or activity assays, nucleic acid hybridization methods, nucleic acid reverse transcription methods, and nucleic acid amplification methods.

In preferred embodiments, the levels of one or more biomarkers listed in Table 1 are ascertained by measuring gene transcript (e.g., mRNA), by a measure of the quantity of translated protein, or by a measure of gene product activity. Expression levels can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

In a particular embodiment, the mRNA expression level can be determined both by in situ and by in vitro formats in a biological sample using methods known in the art. The term "biological sample" is intended to include tissues, cells, biological fluids and isolates thereof, isolated from a subject, as well as tissues, cells and fluids present within a subject. Many expression detection methods use isolated RNA. For in vitro methods, any RNA isolation technique that does not select against the isolation of mRNA can be utilized for the purification of RNA from cells (see, e.g., Ausubel et al., ed., *Current Protocols in Molecular Biology*, John Wiley & Sons, New York 1987-1999). Additionally, large numbers of tissue samples can readily be processed using techniques well-known to those of skill in the art, such as, for example, the single-step RNA isolation process of Chomczynski (1989, U.S. Pat. No. 4,843,155).

The isolated mRNA can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length cDNA, or a portion thereof, such as an oligonucleotide of at least 7, 15, 30, 50, 100, 250 or 500 nucleotides in length and sufficient to specifically hybridize under stringent conditions to a mRNA or genomic DNA encoding one or more biomarkers listed in Table 1. Other suitable probes for use in the diagnostic assays encompassed by the present invention are described herein. Hybridization of an mRNA with the probe indicates that one or more biomarkers listed in Table 1 is being expressed.

In one format, the mRNA is immobilized on a solid surface and contacted with a probe, for example by running the isolated mRNA on an agarose gel and transferring the mRNA from the gel to a membrane, such as nitrocellulose. In an alternative format, the probe(s) are immobilized on a solid surface and the mRNA is contacted with the probe(s), for example, in a gene chip array, e.g., an Affymetrix™ gene chip array. A skilled artisan can readily adapt known mRNA detection methods for use in detecting the level of one or more biomarkers listed in Table 1 mRNA expression levels.

An alternative method for determining mRNA expression level in a sample involves the process of nucleic acid amplification, e.g., by RT-PCR (the experimental embodiment set forth in Mullis, 1987, U.S. Pat. No. 4,683,202), ligase chain reaction (Barany, 1991, *Proc. Natl. Acad. Sci. USA,* 88:189-193), self sustained sequence replication (Guatelli et al., 1990, *Proc. Natl. Acad. Sci. USA* 87:1874-1878), transcriptional amplification system (Kwoh et al., 1989, *Proc. Natl. Acad. Sci. USA* 86:1173-1177), Q-Beta Replicase (Lizardi et al., 1988, *Bio/Technology* 6:1197), rolling circle replication (Lizardi et al., U.S. Pat. No. 5,854,033) or any other nucleic acid amplification method, followed by the detection of the amplified molecules using techniques well-known to those of skill in the art. These detection schemes are especially useful for the detection of nucleic acid molecules if such molecules are present in very low numbers. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, mRNA does not need to be isolated from the cells prior to detection. In such methods, a cell or tissue sample is prepared/processed using known histological methods. The sample is then immobilized on a support, typically a glass slide, and then contacted with a probe that can hybridize to mRNA of one or more biomarkers listed in Table 1.

As an alternative to making determinations based on the absolute expression level, determinations may be based on the normalized expression level of one or more biomarkers listed in Table 1. Expression levels are normalized by correcting the absolute expression level by comparing its expression to the expression of a non-biomarker gene, e.g., a housekeeping gene that is constitutively expressed. Suitable genes for normalization include housekeeping genes such as the actin gene, or epithelial cell-specific genes. This normalization allows the comparison of the expression level in one sample, e.g., a subject sample, to another sample, e.g., a normal sample, or between samples from different sources.

The level or activity of a protein corresponding to one or more biomarkers listed in Table 1 can also be detected and/or quantified by detecting or quantifying the expressed polypeptide. The polypeptide can be detected and quantified by any of a number of means well-known to those of skill in the art. These may include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, and the like. A skilled artisan can readily adapt known protein/antibody detection methods for use in determining whether cells express the biomarker of interest.

The present invention further provides soluble, purified and/or isolated polypeptide forms of one or more biomarkers listed in Table 1, or fragments thereof. In addition, it is to be understood that any and all attributes of the polypeptides described herein, such as percentage identities, polypeptide lengths, polypeptide fragments, biological activities, antibodies, etc. can be combined in any order or combination with respect to one or more biomarkers listed in Table 1.

In one aspect, a polypeptide may comprise a full-length amino acid sequence corresponding to one or more biomarkers listed in Table 1 or a full-length amino acid sequence with 1 to about 20 conservative amino acid substitutions. An amino acid sequence of any described herein can also be at least 50, 55, 60, 65, 70, 75, 80, 85, 90, 91, 92, 93, 94, 95, 96, 97, 98, 99, or 99.5% identical to the full-length sequence of one or more biomarkers listed in Table 1, which is either described herein, well-known in the art, or a fragment thereof. In another aspect, the present invention contemplates a composition comprising an isolated polypeptide corresponding to polypeptide of one or more biomarkers listed in Table 1 and less than about 25%, or alternatively 15%, or alternatively 5%, contaminating biological macromolecules or polypeptides.

The present invention further provides compositions related to producing, detecting, or characterizing such polypeptides, or fragment thereof, such as nucleic acids, vectors, host cells, and the like. Such compositions may serve as compounds that modulate (e.g., enhance) the expression and/or activity of one or more biomarkers listed in Table 1.

An isolated polypeptide or a fragment thereof (or a nucleic acid encoding such a polypeptide) corresponding to one or more biomarkers listed in Table 1, can be used as an immunogen to generate antibodies that bind to said immunogen, using standard techniques for polyclonal and monoclonal antibody preparation according to well-known methods in the art. An antigenic peptide comprises at least 8 amino acid residues and encompasses an epitope present in the respective full length molecule such that an antibody raised against the peptide forms a specific immune complex with the respective full length molecule. Preferably, the antigenic peptide comprises at least 10 amino acid residues. In one embodiment such epitopes can be specific for a given polypeptide molecule from one species, such as mouse or human (i.e., an antigenic peptide that spans a region of the polypeptide molecule that is not conserved across species is used as immunogen; such non conserved residues can be determined using an alignment such as that provided herein).

In one embodiment, an antibody, especially an intrabody, binds substantially specifically to one or more biomarkers listed in Table 1, and enhances its biological function. In another embodiment, an antibody, especially an intrabody, binds substantially specifically to a binding partner of one or more biomarkers listed in Table 1, and enhances its biological function.

Antibodies for use according to the present invention can be generated according to well-known methods in the art. For example, a polypeptide immunogen typically is used to prepare antibodies by immunizing a suitable subject (e.g., rabbit, goat, mouse or other mammal) with the immunogen. An appropriate immunogenic preparation can contain, for example, a recombinantly expressed or chemically synthesized molecule or fragment thereof to which the immune response is to be generated. The preparation can further include an adjuvant, such as Freund's complete or incomplete adjuvant, or similar immunostimulatory agent. Immunization of a suitable subject with an immunogenic preparation induces a polyclonal antibody response to the antigenic peptide contained therein.

Polyclonal antibodies can be prepared as described above by immunizing a suitable subject with a polypeptide immunogen. The polypeptide antibody titer in the immunized subject can be monitored over time by standard techniques, such as with an enzyme linked immunosorbent assay (ELISA) using immobilized polypeptide. If desired, the antibody directed against the antigen can be isolated from the mammal (e.g., from the blood) and further purified by well-known techniques, such as protein A chromatography, to obtain the IgG fraction. At an appropriate time after immunization, e.g., when the antibody titers are highest, antibody-producing cells can be obtained from the subject and used to prepare monoclonal antibodies by standard techniques, such as the hybridoma technique (originally described by Kohler and Milstein (1975) *Nature* 256:495-497) (see also Brown et al. (1981) *J. Immunol.* 127:539-46; Brown et al. (1980) *J. Biol. Chem.* 255:4980-83; Yeh et al. (1976) *Proc. Natl. Acad. Sci.* 76:2927-31; Yeh et al. (1982) *Int. J. Cancer* 29:269-75), the more recent human B cell hybridoma technique (Kozbor et al. (1983) *Immunol. Today* 4:72), the EBV-hybridoma technique (Cole et al. (1985) *Monoclonal Antibodies and Cancer Therapy*, Alan R. Liss, Inc., pp. 77-96) or trioma techniques. The technology for producing monoclonal antibody hybridomas is well-known (see generally Kenneth, R. H. in *Monoclonal Antibodies: A New Dimension In Biological Analyses*, Plenum Publishing Corp., New York, New York (1980); Lerner, E. A. (1981) *Yale J. Biol. Med.* 54:387-402; Gefter, M. L. et al. (1977) *Somatic Cell Genet.* 3:231-36). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds to the polypeptide antigen, preferably specifically.

Any of the many well-known protocols used for fusing lymphocytes and immortalized cell lines can be applied for the purpose of generating a monoclonal antibody against one or more biomarkers listed in Table 1, or a fragment thereof (see, e.g., Galfre, G. et al. (1977) *Nature* 266:55052; Gefter et al. (1977) supra; Lerner (1981) supra; Kenneth (1980) supra). Moreover, the ordinary skilled worker will appreciate that there are many variations of such methods which also would be useful. Typically, the immortal cell line (e.g., a myeloma cell line) is derived from the same mammalian species as the lymphocytes. For example, murine hybridomas can be made by fusing lymphocytes from a mouse immunized with an immunogenic preparation encompassed by the present invention with an immortalized mouse cell line. Preferred immortal cell lines are mouse myeloma cell lines that are sensitive to culture medium containing hypoxanthine, aminopterin and thymidine ("HAT medium"). Any of a number of myeloma cell lines can be used as a fusion partner according to standard techniques, e.g., the P3-NS1/1-Ag4-1, P3-x63-Ag8.653 or Sp2/O-Ag14 myeloma lines. These myeloma lines are available from the American Type Culture Collection (ATCC), Rockville, MD Typically, HAT-sensitive mouse myeloma cells are fused to mouse splenocytes using polyethylene glycol ("PEG"). Hybridoma cells resulting from the fusion are then selected using HAT medium, which kills unfused and unproductively fused myeloma cells (unfused splenocytes die after several days because they are not transformed). Hybridoma cells producing a monoclonal antibody encompassed by the present invention are detected by screening the hybridoma culture supernatants for antibodies that bind a given polypeptide, e.g., using a standard ELISA assay.

As an alternative to preparing monoclonal antibody-secreting hybridomas, a monoclonal specific for one of the above described polypeptides can be identified and isolated by screening a recombinant combinatorial immunoglobulin library (e.g., an antibody phage display library) with the appropriate polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP™ Phage Display Kit, Catalog No. 240612). Additionally, examples of methods and reagents particularly amenable for use in generating and screening an antibody display library can be found in, for example, Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) *Biotechnology* (NY) 9:1369-1372; Hay et al. (1992) *Hum. Antibod. Hybridomas* 3:81-85; Huse et al. (1989) *Science* 246:1275-1281; Griffiths et al. (1993) *EMBO J.* 12:725-734; Hawkins et al. (1992) *J Mol. Biol.* 226:889-896; Clarkson et al. (1991) *Nature* 352:624-628; Gram et al. (1992) *Proc. Natl. Acad. Sci. USA* 89:3576-3580; Garrard et at (1991) *Biotechnology* (NY) 9:1373-1377; Hoogenboom et al. (1991) *Nucleic Acids Res.* 19:4133-4137; Barbas et al. (1991) *Proc. Natl. Acad. Sci. USA* 88:7978-7982; and McCafferty et al. (1990) *Nature* 348:552-554.

Since it is well-known in the art that antibody heavy and light chain CDR3 domains play a particularly important role in the binding specificity/affinity of an antibody for an antigen, the recombinant monoclonal antibodies encompassed by the present invention prepared as set forth above preferably comprise the heavy and light chain CDR3s of variable regions of antibodies of interest. The antibodies further can comprise the CDR2s of variable regions encompassed by the present invention. The antibodies further can comprise the CDR's of variable regions encompassed by the present invention. In other embodiments, the antibodies can comprise any combinations of the CDRs.

The CDR1, 2, and/or 3 regions of the engineered antibodies described above can comprise the exact amino acid sequence(s) as those of variable regions encompassed by the present invention. However, the ordinarily skilled artisan will appreciate that some deviation from the exact CDR sequences may be possible while still retaining the ability of the antibody to bind a target of interest, such as one or more biomarkers listed in Table 1 and/or one or more natural binding partners effectively (e.g., conservative sequence modifications). Accordingly, in another embodiment, the engineered antibody may be composed of one or more CDRs that are, for example, 50%, 60%, 70%, 80%, 85%, 90%, 91%, 92%, 93%, 94%, 95%, 96%, 97%, 98%, 99%, or 99.5% identical to one or more CDRs encompassed by the present invention.

For example, the structural features of non-human or human antibodies (e.g., a rat anti-mouse/anti-human antibody) can be used to create structurally related human antibodies, especially introbodies, that retain at least one functional property of the antibodies encompassed by the present invention, such as binding to one or more biomarkers listed in Table 1, binding partners/substrates of one or more biomarkers listed in Table 1, and/or an immune checkpoint. Another functional property includes inhibiting binding of the original known, non-human or human antibodies in a competition ELISA assay.

A skilled artisan will note that such percentage homology is equivalent to and can be achieved by introducing 1, 2, 3, 4, 5, 6, 7, 8, 9, 10, or more conservative amino acid substitutions within a given CDR.

The monoclonal antibodies encompassed by the present invention can comprise a heavy chain, wherein the variable domain comprises at least a CDR having a sequence selected from the group consisting of the heavy chain variable domain CDRs described herein, and a light chain, wherein the variable domain comprises at least a CDR having a sequence selected from the group consisting of the light chain variable domain CDRs described herein.

Such monoclonal antibodies can comprise a light chain, wherein the variable domain comprises at least a CDR having a sequence selected from the group consisting of CDR-L1, CDR-L2, and CDR-L3, as described herein; and/or a heavy chain, wherein the variable domain comprises at least a CDR having a sequence selected from the group consisting of CDR-H1, CDR-H2, and CDR-H3, as described herein. In some embodiments, the monoclonal antibodies capable of binding one or more biomarkers listed in Table 1, comprises or consists of CDR-L1, CDR-L2, CDR-L3, CDR-H1, CDR-H2, and CDR-H3, as described herein.

The heavy chain variable domain of the monoclonal antibodies encompassed by the present invention can comprise or consist of the vH amino acid sequence set forth herein and/or the light chain variable domain of the monoclonal antibodies encompassed by the present invention can comprise or consist of the vκ amino acid sequence set forth herein.

The present invention further provides fragments of said monoclonal antibodies which include, but are not limited to, Fv, Fab, F(ab')2, Fab', dsFv, scFv, sc(Fv)2 and diabodies; and multispecific antibodies formed from antibody fragments. For example, a number of immunoinhibitory molecules, such as PD-L1, PD-1, CTLA-4, and the like, can be bound in a bispecific or multispecific manner.

Other fragments of the monoclonal antibodies encompassed by the present invention are also contemplated. For example, individual immunoglobulin heavy and/or light chains are provided, wherein the variable domains thereof comprise at least a CDR described herein. In one embodiment, the immunoglobulin heavy chain comprises at least a CDR having a sequence that is at least 80%, 85%, 90%, 91%, 92%, 93%, 94%, 95%, 96%, 97%, 98%, 99%, 99.5% or 100% identical from the group of heavy chain or light chain variable domain CDRs described herein. In another embodiment, an immunoglobulin light chain comprises at least a CDR having a sequence that is at least 80%, 85%, 90%, 91%, 92%, 93%, 94%, 95%, 96%, 97%, 98%, 99%, 99.5% or 100% identical from the group of light chain or heavy chain variable domain CDRs described herein, are also provided.

In some embodiments, the immunoglobulin heavy and/or light chain comprises a variable domain comprising at least one of CDR-L1, CDR-L2, CDR-L3, CDR-H1, CDR-H2, or CDR-H3 described herein. Such immunoglobulin heavy chains can comprise or consist of at least one of CDR-H1, CDR-H2, and CDR-H3. Such immunoglobulin light chains can comprise or consist of at least one of CDR-L1, CDR-L2, and CDR-L3.

In other embodiments, an immunoglobulin heavy and/or light chain according to the present invention comprises or consists of a vH or vκ variable domain sequence, respectively, described herein.

The present invention further provides polypeptides which have a sequence selected from the group consisting of vH variable domain, vκ variable domain, CDR-L1, CDR-L2, CDR-L3, CDR-H1, CDR-H2, and CDR-H3 sequences described herein.

Antibodies, immunoglobulins, and polypeptides encompassed by the present invention can be use in an isolated (e.g., purified) form or contained in a vector, such as a membrane or lipid vesicle (e.g. a liposome).

Amino acid sequence modification(s) of the antibodies described herein are contemplated. For example, it may be desirable to improve the binding affinity and/or other biological properties of the antibody. It is known that when a humanized antibody is produced by simply grafting only CDRs in VH and VL of an antibody derived from a non-human animal in FRs of the VH and VL of a human antibody, the antigen binding activity is reduced in comparison with that of the original antibody derived from a non-human animal. It is considered that several amino acid residues of the VH and VL of the non-human antibody, not only in CDRs but also in FRs, are directly or indirectly associated with the antigen binding activity. Hence, substitution of these amino acid residues with different amino acid residues derived from FRs of the VH and VL of the human antibody would reduce binding activity and can be corrected by replacing the amino acids with amino acid residues of the original antibody derived from a non-human animal.

Modifications and changes may be made in the structure of the antibodies encompassed by the present invention, and in the DNA sequences encoding them, and still obtain a functional molecule that encodes an antibody and polypeptide with desirable characteristics. For example, certain amino acids may be substituted by other amino acids in a protein structure without appreciable loss of activity. Since the interactive capacity and nature of a protein define the protein's biological functional activity, certain amino acid substitutions can be made in a protein sequence, and, of course, in its DNA encoding sequence, while nevertheless obtaining a protein with like properties. It is thus contemplated that various changes may be made in the antibodies sequences encompassed by the present invention, or corresponding DNA sequences which encode said polypeptides, without appreciable loss of their biological activity.

In making the changes in the amino sequences of polypeptide, the hydropathic index of amino acids may be considered. The importance of the hydropathic amino acid index in conferring interactive biologic function on a protein is generally understood in the art. It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. Each amino acid has been assigned a hydropathic index on the basis of their hydrophobicity and charge characteristics these are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophane (−0.9); tyrosine (−1.3); proline (−1.6); histidine (−3.2); glutamate (−3.5); glutamine (−3.5); aspartate (<RTI 3.5); asparagine (−3.5); lysine (−3.9); and arginine (−4.5).

It is known in the art that certain amino acids may be substituted by other amino acids having a similar hydropathic index or score and still result in a protein with similar biological activity, i.e. still obtain a biological functionally equivalent protein.

As outlined above, amino acid substitutions are generally therefore based on the relative similarity of the amino acid side-chain substituents, for example, their hydrophobicity, hydrophilicity, charge, size, and the like. Exemplary substitutions which take various of the foregoing characteristics into consideration are well-known to those of skill in the art and include: arginine and lysine; glutamate and aspartate; serine and threonine; glutamine and asparagine; and valine, leucine and isoleucine.

Another type of amino acid modification of the antibody encompassed by the present invention may be useful for altering the original glycosylation pattern of the antibody to, for example, increase stability. By "altering" is meant deleting one or more carbohydrate moieties found in the antibody, and/or adding one or more glycosylation sites that are not present in the antibody. Glycosylation of antibodies is typically N-linked. "N-linked" refers to the attachment of the carbohydrate moiety to the side chain of an asparagine residue. The tripeptide sequences asparagine-X-serine and asparagines-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site. Addition of glycosylation sites to the antibody is conveniently accomplished by altering the amino acid sequence such that it contains one or more of the above-described tripeptide sequences (for N-linked glycosylation sites). Another type of covalent modification involves chemically or enzymatically coupling glycosides to the antibody. These procedures are advantageous in that they do not require production of the antibody in a host cell that has glycosylation capabilities for N- or O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. For example, such methods are described in WO87/05330.

Similarly, removal of any carbohydrate moieties present on the antibody may be accomplished chemically or enzymatically. Chemical deglycosylation requires exposure of the antibody to the compound trifluoromethanesulfonic acid, or an equivalent compound. This treatment results in the cleavage of most or all sugars except the linking sugar (N-acetylglucosamine or N-acetylgalactosamine), while leaving the antibody intact. Chemical deglycosylation is described by Sojahr et al. (1987) and by Edge et al. (1981). Enzymatic cleavage of carbohydrate moieties on antibodies can be achieved by the use of a variety of endo- and exo-glycosidases as described by Thotakura et al. (1987).

Other modifications can involve the formation of immunoconjugates. For example, in one type of covalent modification, antibodies or proteins are covalently linked to one of a variety of non proteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192 or 4,179,337.

Conjugation of antibodies or other proteins encompassed by the present invention with heterologous agents can be made using a variety of bifunctional protein coupling agents including but not limited to N-succinimidyl (2-pyridyldithio) propionate (SPDP), succinimidyl (N-maleimidomethyl)cyclohexane-1-carboxylate, iminothiolane (IT), bifunctional derivatives of imidoesters (such as dimethyl adipimidate HCL), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as tolyene 2,6diisocyanate), and bis-active fluorine compounds (such as 1,5-difluoro-2,4-dinitrobenzene). For example, carbon labeled 1-isothiocyanatobenzyl methyldiethylene triaminepentaacetic acid (MX-DTPA) is an exemplary chelating agent for conjugation of radionucleotide to the antibody (WO 94/11026).

In another aspect, the present invention features antibodies conjugated to a therapeutic moiety, such as a cytotoxin, a drug, and/or a radioisotope. When conjugated to a cytotoxin, these antibody conjugates are referred to as "immunotoxins." A cytotoxin or cytotoxic agent includes any agent that is detrimental to (e.g., kills) cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, and puromycin and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine). An antibody encompassed by the present invention can be conjugated to a radioisotope, e.g., radioactive iodine, to generate cytotoxic radiopharmaceuticals for treating a related disorder, such as a cancer.

Conjugated antibodies can be used diagnostically or prognostically to monitor polypeptide levels in tissue as part of a clinical testing procedure, e.g., to determine the efficacy of a given treatment regimen. Detection can be facilitated by coupling (i e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, P-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate (FITC), rhodamine, dichlorotriazinylamine fluorescein, dansyl chloride or phycoerythrin (PE); an example of a luminescent material includes luminol; examples of bioluminescent materials include luciferase, luciferin, and aequorin, and examples of suitable radioactive material include $^{125}I$, $^{35}S$, or $^{3}H$. [0134] As used herein, the term "labeled", with regard to the antibody, is intended to encompass direct labeling of the antibody by coupling (i.e., physically linking) a detectable substance, such as a radioactive agent or a fluorophore (e.g. fluorescein isothiocyanate (FITC) or phycoerythrin (PE) or Indocyanine (Cy5)) to the antibody, as well as indirect labeling of the antibody by reactivity with a detectable substance.

The antibody conjugates encompassed by the present invention can be used to modify a given biological response. The therapeutic moiety is not to be construed as limited to classical chemical therapeutic agents. For example, the drug moiety may be a protein or polypeptide possessing a desired biological activity. Such proteins may include, for example, an enzymatically active toxin, or active fragment thereof, such as abrin, ricin A, *Pseudomonas* exotoxin, or diphtheria toxin; a protein such as tumor necrosis factor or interferon-.gamma.; or, biological response modifiers such as, for example, lymphokines, interleukin-1 ("IL-1"), interleukin-2 ("IL-2"), interleukin-6 ("IL-6"), granulocyte macrophage colony stimulating factor ("GM-CSF"), granulocyte colony stimulating factor ("G-CSF"), or other cytokines or growth factors.

Techniques for conjugating such therapeutic moiety to antibodies are well-known, see, e.g., Arnon et al., "Monoclonal Antibodies For Immunotargeting Of Drugs In Cancer Therapy", in Monoclonal Antibodies And Cancer Therapy, Reisfeld et al. (eds.), pp. 243 56 (Alan R. Liss, Inc. 1985); Hellstrom et al., "Antibodies For Drug Delivery", in Controlled Drug Delivery (2nd Ed.), Robinson et al. (eds.), pp. 623 53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475 506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303 16 (Academic Press 1985), and Thorpe et al., "The Preparation And Cytotoxic Properties Of Antibody-Toxin Conjugates", Immunol. Rev., 62:119 58 (1982).

In some embodiments, conjugations can be made using a "cleavable linker" facilitating release of the cytotoxic agent or growth inhibitory agent in a cell. For example, an acid-labile linker, peptidase-sensitive linker, photolabile linker, dimethyl linker or disulfide-containing linker (See e.g. U.S. Pat. No. 5,208,020) may be used. Alternatively, a fusion protein comprising the antibody and cytotoxic agent or growth inhibitory agent may be made, by recombinant techniques or peptide synthesis. The length of DNA may comprise respective regions encoding the two portions of the conjugate either adjacent one another or separated by a region encoding a linker peptide which does not destroy the desired properties of the conjugate.

Additionally, recombinant polypeptide antibodies, such as chimeric and humanized monoclonal antibodies, comprising both human and non-human portions, which can be made using standard recombinant DNA techniques, are within the scope encompassed by the present invention. Such chimeric and humanized monoclonal antibodies can be produced by recombinant DNA techniques known in the art, for example using methods described in Robinson et al. International Patent Publication PCT/US86/02269; Akira et al. European Patent Application 184,187; Taniguchi, M. European Patent Application 171,496; Morrison et al. European Patent Application 173,494; Neuberger et al. PCT Application WO 86/01533; Cabilly et al. U.S. Pat. No. 4,816,567; Cabilly et al. European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci.* 84:214-218; Nishimura et al. (1987) *Cancer Res.* 47:999-1005; Wood et al. (1985) *Nature* 314:446-449; Shaw et al. (1988) *J. Natl. Cancer Inst.* 80:1553-1559); Morrison, S. L. (1985) *Science* 229:1202-1207; Oi et al. (1986) *Biotechniques* 4:214; Winter U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

In addition, humanized antibodies can be made according to standard protocols such as those disclosed in U.S. Pat. No. 5,565,332. In another embodiment, antibody chains or specific binding pair members can be produced by recombination between vectors comprising nucleic acid molecules encoding a fusion of a polypeptide chain of a specific binding pair member and a component of a replicable generic display package and vectors containing nucleic acid molecules encoding a second polypeptide chain of a single binding pair member using techniques known in the art, e.g., as described in U.S. Pat. Nos. 5,565,332, 5,871,907, or 5,733,743. The use of intracellular antibodies to inhibit protein function in a cell is also known in the art (see e.g., Carlson, J. R. (1988) *Mol. Cell. Biol.* 8:2638-2646; Biocca, S. et al. (1990) *EMBO J* 9:101-108; Werge, T. M. et al. (1990) *FEES Lett.* 274:193-198; Carlson, J. R. (1993) *Proc. Natl. Acad. Sci. USA* 90:7427-7428; Marasco, W. A. et al. (1993) *Proc. Natl. Acad. Sci. USA* 90:7889-7893; Biocca, S. et al. (1994) Biotechnology (IVY) 12:396-399; Chen, S-Y. et al. (1994) *Hum. Gene Ther.* 5:595-601; Duan, L et al. (1994) *Proc. Natl. Acad. Sci. USA* 91:5075-5079; Chen, S-Y. et al. (1994) *Proc. Natl. Acad. Sci. USA* 91:5932-5936; Beerli, R. R. et al. (1994) *J. Biol. Chem.* 269:23931-23936; Beerli, R. R. et al. (1994) *Biochem. Biophys. Res. Commun.* 204:666-672; Mhashilkar, A. M. et al. (1995) *EMBO J* 14:1542-1551; Richardson, J. H. et at (1995) *Proc. Natl. Acad. Sci. USA* 92:3137-3141; PCT Publication No. WO 94/02610 by Marasco et al.; and PCT Publication No. WO 95/03832 by Duan et al.).

Additionally, fully human antibodies could be made against one or more biomarkers listed in Table 1, or fragments thereof. Fully human antibodies can be made in mice that are transgenic for human immunoglobulin genes, e.g. according to Hogan et al., "Manipulating the Mouse Embryo: A Laboratory Manuel," Cold Spring Harbor Laboratory. Briefly, transgenic mice are immunized with purified immunogen. Spleen cells are harvested and fused to myeloma cells to produce hybridomas. Hybridomas are selected based on their ability to produce antibodies which bind to the immunogen. Fully human antibodies would reduce the immunogenicity of such antibodies in a human.

In one embodiment, an antibody for use in the instant invention is a bispecific antibody. A bispecific antibody has binding sites for two different antigens within a single antibody polypeptide. Antigen binding may be simultaneous or sequential. Triomas and hybrid hybridomas are two examples of cell lines that can secrete bispecific antibodies. Examples of bispecific antibodies produced by a hybrid hybridoma or a trioma are disclosed in U.S. Pat. No. 4,474,893. Bispecific antibodies have been constructed by chemical means (Staerz et al. (1985) *Nature* 314:628, and Perez et al. (1985) *Nature* 316:354) and hybridoma technology (Staerz and Bevan (1986) *Proc. Natl. Acad. Sci. USA,* 83:1453, and Staerz and Bevan (1986) *Immunol. Today* 7:241). Bispecific antibodies are also described in U.S. Pat. No. 5,959,084. Fragments of bispecific antibodies are described in U.S. Pat. No. 5,798,229.

Bispecific agents can also be generated by making heterohybridomas by fusing hybridomas or other cells making different antibodies, followed by identification of clones producing and co-assembling both antibodies. They can also be generated by chemical or genetic conjugation of complete immunoglobulin chains or portions thereof such as Fab and Fv sequences. The antibody component can bind to a polypeptide or a fragment thereof of one or more biomarkers encompassed by the present invention, including one or more biomarkers listed in Table 1, or a fragment thereof. In one embodiment, the bispecific antibody could specifically bind to both a polypeptide or a fragment thereof and its natural binding partner(s) or a fragment(s) thereof.

In another aspect encompassed by the present invention, peptides or peptide mimetics can be used to agonize the activity of one or more biomarkers encompassed by the present invention, including one or more biomarkers listed in Table 1, or a fragment(s) thereof. In one embodiment, variants of one or more biomarkers listed in Table 1 which function as a modulating agent for the respective full length protein, can be identified by screening combinatorial libraries of mutants, e.g., truncation mutants, for agonist activity. In one embodiment, a variegated library of variants is generated by combinatorial mutagenesis at the nucleic acid level and is encoded by a variegated gene library. A variegated library of variants can be produced and screened using methods described above. The production of peptides and peptidomimetics are also described herein.

Also encompassed by the present invention are small molecules which can modulate (e.g., enhance) interactions, e.g., between one or more biomarkers listed in Table 1 and their natural binding partners. The small molecules encompassed by the present invention can be obtained using any of the numerous approaches in combinatorial library methods known in the art, including: spatially addressable parallel solid phase or solution phase libraries; synthetic library methods requiring deconvolution; the 'one-bead one-compound' library method; and synthetic library methods using affinity chromatography selection. (Lam, K. S. (1997) *Anticancer Drug Des.* 12:145).

Examples of methods for the synthesis of molecular libraries can be found in the art, for example in: DeWitt et al. (1993) *Proc. Natl. Acad. Sci. USA* 90:6909; Erb et al. (1994) *Proc. Natl. Acad. Sci. USA* 91:11422; Zuckermann et al. (1994) *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233.

Libraries of compounds can be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner U.S. Pat. No. 5,223,409), spores (Ladner USP '409), plasmids (Cull et al. (1992) *Proc. Natl. Acad. Sci. USA* 89:1865-1869) or on phage (Scott and Smith (1990) *Science* 249:386-390); (Devlin (1990) *Science* 249:404-406); (Cwirla et al. (1990) *Proc. Natl. Acad. Sci. USA* 87:6378-6382); (Felici (1991) *J. Mol. Biol.* 222:301-310); (Ladner supra.). Compounds can be screened in cell based or non-cell based assays. Compounds can be screened in pools (e.g. multiple compounds in each testing sample) or as individual compounds.

The invention also relates to chimeric or fusion proteins of the biomarkers encompassed by the present invention, including one or more biomarkers listed in Table 1, or fragments thereof. As used herein, a "chimeric protein" or "fusion protein" comprises one or more biomarkers encompassed by the present invention, including one or more biomarkers listed in Table 1, or a fragment thereof, operatively linked to another polypeptide having an amino acid sequence corresponding to a protein which is not substantially homologous to the respective biomarker. In a preferred embodiment, the fusion protein comprises at least one biologically active portion of one or more biomarkers encompassed by the present invention, including one or more biomarkers listed in Table 1, or fragments thereof. Within the fusion protein, the term "operatively linked" is intended to indicate that the biomarker sequences and the non-biomarker sequences are fused in-frame to each other in such a way as to preserve functions exhibited when expressed independently of the fusion. The "another" sequences can be fused to the N-terminus or C-terminus of the biomarker sequences, respectively.

Such a fusion protein can be produced by recombinant expression of a nucleotide sequence encoding the first peptide and a nucleotide sequence encoding the second peptide. The second peptide may optionally correspond to a moiety that alters the solubility, affinity, stability or valency of the first peptide, for example, an immunoglobulin constant region. In another preferred embodiment, the first peptide consists of a portion of a biologically active molecule (e.g. the extracellular portion of the polypeptide or the ligand binding portion). The second peptide can include an immunoglobulin constant region, for example, a human Cγ1 domain or Cγ4 domain (e.g., the hinge, CH2 and CH3 regions of human IgCγ1, or human IgCγ4, see e.g., Capon et al. U.S. Pat. Nos. 5,116,964; 5,580,756; 5,844,095 and the like, incorporated herein by reference). Such constant regions may retain regions which mediate effector function (e.g. Fc receptor binding) or may be altered to reduce effector function. A resulting fusion protein may have altered solubility, binding affinity, stability and/or valency (i.e., the number of binding sites available per polypeptide) as compared to the independently expressed first peptide, and may increase the efficiency of protein purification. Fusion proteins and peptides produced by recombinant techniques can be secreted and isolated from a mixture of cells and medium containing the protein or peptide. Alternatively, the protein or peptide can be retained cytoplasmically and the cells harvested, lysed and the protein isolated. A cell culture typically includes host cells, media and other byproducts. Suitable media for cell culture are well-known in the art. Protein and peptides can be isolated from cell culture media, host cells, or both using techniques known in the art for purifying proteins and peptides. Techniques for transfecting host cells and purifying proteins and peptides are known in the art.

Preferably, a fusion protein encompassed by the present invention is produced by standard recombinant DNA techniques. For example, DNA fragments coding for the different polypeptide sequences are ligated together in-frame in accordance with conventional techniques, for example employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992).

In another embodiment, the fusion protein contains a heterologous signal sequence at its N-terminus. In certain host cells (e.g., mammalian host cells), expression and/or secretion of a polypeptide can be increased through use of a heterologous signal sequence.

The fusion proteins encompassed by the present invention can be used as immunogens to produce antibodies in a subject. Such antibodies may be used to purify the respective natural polypeptides from which the fusion proteins were generated, or in screening assays to identify polypeptides which inhibit the interactions between one or more biomarkers polypeptide or a fragment thereof and its natural binding partner(s) or a fragment(s) thereof.

The modulatory agents described herein (e.g., nucleic acids, peptides, antibodies, small molecules, or fusion proteins) can be incorporated into pharmaceutical compositions and administered to a subject in vivo. The compositions may contain a single such molecule or agent or any combination of agents described herein. "Single active agents" described herein can be combined with other pharmacologically active compounds ("second active agents") known in the art according to the methods and compositions provided herein. It is believed that certain combinations work synergistically in the treatment of conditions that would benefit from the mouldation of immune responses. Second active agents can be large molecules (e.g., proteins) or small molecules (e.g., synthetic inorganic, organometallic, or organic molecules).

Biomarker nucleic acids and/or biomarker polypeptides can be analyzed according to the methods described herein and techniques known to the skilled artisan to identify such genetic or expression alterations useful for the present invention including, but not limited to, 1) an alteration in the level of a biomarker transcript or polypeptide, 2) a deletion or addition of one or more nucleotides from a biomarker gene, 4) a substitution of one or more nucleotides of a biomarker gene, 5) aberrant modification of a biomarker gene, such as an expression regulatory region, and the like.

1. Methods for Detection of Copy Number

Methods of evaluating the copy number of a biomarker nucleic acid are well-known to those of skill in the art. The presence or absence of chromosomal gain or loss can be evaluated simply by a determination of copy number of the regions or markers identified herein.

In one embodiment, a biological sample is tested for the presence of copy number changes in genomic loci containing the genomic marker.

Methods of evaluating the copy number of a biomarker locus include, but are not limited to, hybridization-based assays. Hybridization-based assays include, but are not limited to, traditional "direct probe" methods, such as Southern blots, in situ hybridization (e.g., FISH and FISH plus SKY) methods, and "comparative probe" methods, such as comparative genomic hybridization (CGH), e.g., cDNA-based or oligonucleotide-based CGH. The methods can be used in a wide variety of formats including, but not limited to, substrate (e.g. membrane or glass) bound methods or array-based approaches.

In one embodiment, evaluating the biomarker gene copy number in a sample involves a Southern Blot. In a Southern Blot, the genomic DNA (typically fragmented and separated on an electrophoretic gel) is hybridized to a probe specific for the target region. Comparison of the intensity of the hybridization signal from the probe for the target region with control probe signal from analysis of normal genomic DNA (e.g., a non-amplified portion of the same or related cell, tissue, organ, etc.) provides an estimate of the relative copy number of the target nucleic acid. Alternatively, a Northern blot may be utilized for evaluating the copy number of encoding nucleic acid in a sample. In a Northern blot, mRNA is hybridized to a probe specific for the target region. Comparison of the intensity of the hybridization signal from the probe for the target region with control probe signal from analysis of normal RNA (e.g., a non-amplified portion of the same or related cell, tissue, organ, etc.) provides an estimate of the relative copy number of the target nucleic acid. Alternatively, other methods well-known in the art to detect RNA can be used, such that higher or lower expression relative to an appropriate control (e.g., a non-amplified portion of the same or related cell tissue, organ, etc.) provides an estimate of the relative copy number of the target nucleic acid.

An alternative means for determining genomic copy number is in situ hybridization (e.g., Angerer (1987)*Meth. Enzymol* 152: 649). Generally, in situ hybridization comprises the following steps: (1) fixation of tissue or biological structure to be analyzed; (2) prehybridization treatment of the biological structure to increase accessibility of target DNA, and to reduce nonspecific binding; (3) hybridization of the mixture of nucleic acids to the nucleic acid in the biological structure or tissue; (4) post-hybridization washes to remove nucleic acid fragments not bound in the hybridization and (5) detection of the hybridized nucleic acid fragments. The reagent used in each of these steps and the conditions for use vary depending on the particular application. In a typical in situ hybridization assay, cells are fixed to a solid support, typically a glass slide. If a nucleic acid is to be probed, the cells are typically denatured with heat or alkali. The cells are then contacted with a hybridization solution at a moderate temperature to permit annealing of labeled probes specific to the nucleic acid sequence encoding the protein. The targets (e.g., cells) are then typically washed at a predetermined stringency or at an increasing stringency until an appropriate signal to noise ratio is obtained. The probes are typically labeled, e.g., with radioisotopes or fluorescent reporters. In one embodiment, probes are sufficiently long so as to specifically hybridize with the target nucleic acid(s) under stringent conditions. Probes generally range in length from about 200 bases to about 1000 bases. In some applications it is necessary to block the hybridization capacity of repetitive sequences. Thus, in some embodiments, tRNA, human genomic DNA, or Cot-I DNA is used to block non-specific hybridization.

An alternative means for determining genomic copy number is comparative genomic hybridization. In general, genomic DNA is isolated from normal reference cells, as well as from test cells (e.g., tumor cells) and amplified, if necessary. The two nucleic acids are differentially labeled and then hybridized in situ to metaphase chromosomes of a reference cell. The repetitive sequences in both the reference and test DNAs are either removed or their hybridization capacity is reduced by some means, for example by prehybridization with appropriate blocking nucleic acids and/or including such blocking nucleic acid sequences for said repetitive sequences during said hybridization. The bound, labeled DNA sequences are then rendered in a visualizable form, if necessary. Chromosomal regions in the test cells which are at increased or decreased copy number can be identified by detecting regions where the ratio of signal from the two DNAs is altered. For example, those regions that have decreased in copy number in the test cells will show relatively lower signal from the test DNA than the reference compared to other regions of the genome. Regions that have been increased in copy number in the test cells will show relatively higher signal from the test DNA. Where there are chromosomal deletions or multiplications, differences in the ratio of the signals from the two labels will be detected and the ratio will provide a measure of the copy number. In another embodiment of CGH, array CGH (aCGH), the immobilized chromosome element is replaced with a collection of solid support bound target nucleic acids on an array, allowing for a large or complete percentage of the genome to be represented in the collection of solid support bound targets. Target nucleic acids may comprise cDNAs, genomic DNAs, oligonucleotides (e.g., to detect single nucleotide polymorphisms) and the like. Array-based CGH may also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays. Methods of preparing immobilized chromosomes or arrays and performing comparative genomic hybridization are well-known in the art (see, e.g., U.S. Pat. Nos. 6,335,167; 6,197,501; 5,830,645; and 5,665,549 and Albertson (1984) *EMBO J.* 3: 1227-1234; Pinkel (1988) *Proc. Natl. Acad. Sci. USA* 85: 9138-9142; EPO Pub. No. 430,402;

*Methods in Molecular Biology*, Vol. 33: In situ Hybridization Protocols, Choo, ed., Humana Press, Totowa, N.J. (1994), etc.). In another embodiment, the hybridization protocol of Pinkel et al. (1998) *Nature Genetics* 20: 207-211, or of Kallioniemi (1992) *Proc. Natl Acad Sci USA* 89:5321-5325 (1992) is used.

In still another embodiment, amplification-based assays can be used to measure copy number. In such amplification-based assays, the nucleic acid sequences act as a template in an amplification reaction (e.g., Polymerase Chain Reaction (PCR). In a quantitative amplification, the amount of amplification product will be proportional to the amount of template in the original sample. Comparison to appropriate controls, e.g. healthy tissue, provides a measure of the copy number.

Methods of "quantitative" amplification are well-known to those of skill in the art. For example, quantitative PCR involves simultaneously co-amplifying a known quantity of a control sequence using the same primers. This provides an internal standard that may be used to calibrate the PCR reaction. Detailed protocols for quantitative PCR are provided in Innis et al. (1990) PCR Protocols, *A Guide to Methods and Applications*, Academic Press, Inc. N.Y.). Measurement of DNA copy number at microsatellite loci using quantitative PCR analysis is described in Ginzonger et al. (2000) *Cancer Research* 60:5405-5409. The known nucleic acid sequence for the genes is sufficient to enable one of skill in the art to routinely select primers to amplify any portion of the gene. Fluorogenic quantitative PCR may also be used in the methods encompassed by the present invention. In fluorogenic quantitative PCR, quantitation is based on amount of fluorescence signals, e.g., TaqMan and SYBR green.

Other suitable amplification methods include, but are not limited to, ligase chain reaction (LCR) (see Wu and Wallace (1989) *Genomics* 4: 560, Landegren et al. (1988) *Science* 241:1077, and Barringer et al. (1990) *Gene* 89: 117), transcription amplification (Kwoh et al. (1989) *Proc. Natl. Acad. Sci. USA* 86: 1173), self-sustained sequence replication (Guatelli et al. (1990) *Proc. Nat. Acad. Sci. USA* 87: 1874), dot PCR, and linker adapter PCR, etc.

Loss of heterozygosity (LOH) and major copy proportion (MCP) mapping (Wang, Z. C. et al. (2004) *Cancer Res* 64(1):64-71; Seymour, A. B. et al. (1994) *Cancer Res* 54, 2761-4; Hahn, S. A. et al. (1995) *Cancer Res* 55, 4670-5; Kimura, M. et al. (1996) *Genes Chromosomes Cancer* 17, 88-93; Li et at, (2008) *MBC Bioinform.* 9, 204-219) may also be used to identify regions of amplification or deletion.

2. Methods for Detection of Biomarker Nucleic Acid Expression

Biomarker expression may be assessed by any of a wide variety of well-known methods for detecting expression of a transcribed molecule or protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In preferred embodiments, activity of a particular gene is characterized by a measure of gene transcript (e.g. mRNA), by a measure of the quantity of translated protein, or by a measure of gene product activity. Marker expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular in comparison with a control level. The type of level being detected will be clear from the context.

In another embodiment, detecting or determining expression levels of a biomarker and functionally similar homologs thereof, including a fragment or genetic alteration thereof (e.g., in regulatory or promoter regions thereof) comprises detecting or determining RNA levels for the marker of interest. In one embodiment, one or more cells from the subject to be tested are obtained and RNA is isolated from the cells. In a preferred embodiment, a sample of breast tissue cells is obtained from the subject.

In one embodiment, RNA is obtained from a single cell. For example, a cell can be isolated from a tissue sample by laser capture microdissection (LCM). Using this technique, a cell can be isolated from a tissue section, including a stained tissue section, thereby assuring that the desired cell is isolated (see, e.g., Bonner et al. (1997) *Science* 278: 1481; Emmert-Buck et ed. (1996) *Science* 274:998; Fend et al. (1999) *Am. J. Path.* 154: 61 and Murakami et al. (2000) *Kidney Int.* 58:1346). For example, Murakami et al., supra, describe isolation of a cell from a previously immunostained tissue section.

It is also be possible to obtain cells from a subject and culture the cells in vitro, such as to obtain a larger population of cells from which RNA can be extracted. Methods for establishing cultures of non-transformed cells, i.e., primary cell cultures, are known in the art.

When isolating RNA from tissue samples or cells from individuals, it may be important to prevent any further changes in gene expression after the tissue or cells has been removed from the subject. Changes in expression levels are known to change rapidly following perturbations, e.g., heat shock or activation with lipopolysaccharide (LPS) or other reagents. In addition, the RNA in the tissue and cells may quickly become degraded. Accordingly, in a preferred embodiment, the tissue or cells obtained from a subject is snap frozen as soon as possible.

RNA can be extracted from the tissue sample by a variety of methods, e.g., the guanidium thiocyanate lysis followed by CsCl centrifugation (Chirgwin et al., 1979*, Biochemistry* 18:5294-5299). RNA from single cells can be obtained as described in methods for preparing cDNA libraries from single cells, such as those described in Dulac, C. (1998) *Curr. Top. Dev. Biol.* 36, 245 and Jena et al. (1996) *J. Immunol. Methods* 190:199. Care to avoid RNA degradation must be taken, e.g., by inclusion of RNAsin. The RNA sample can then be enriched in particular species. In one embodiment, poly(A)+ RNA is isolated from the RNA sample. In general, such purification takes advantage of the poly-A tails on mRNA. In particular and as noted above, poly-T oligonucleotides may be immobilized within on a solid support to serve as affinity ligands for mRNA. Kits for this purpose are commercially available, e.g., the MessageMaker kit (Life Technologies, Grand Island, NY).

In a preferred embodiment, the RNA population is enriched in marker sequences. Enrichment can be undertaken, e.g., by primer-specific cDNA synthesis, or multiple rounds of linear amplification based on cDNA synthesis and template-directed in vitro transcription (see, e.g., Wang et al. (1989) *Proc. Natl. Acad. Sci. U.S.A.* 86: 9717; Dulac et al., supra, and Jena et al., supra).

The population of RNA, enriched or not in particular species or sequences, can further be amplified. As defined herein, an "amplification process" is designed to strengthen, increase, or augment a molecule within the RNA. For example, where RNA is mRNA, an amplification process such as RT-PCR can be utilized to amplify the mRNA, such that a signal is detectable or detection is enhanced. Such an amplification process is beneficial particularly when the biological, tissue, or tumor sample is of a small size or volume.

Various amplification and detection methods can be used. For example, it is within the scope encompassed by the present invention to reverse transcribe mRNA into cDNA followed by polymerase chain reaction (RT-PCR); or, to use a single enzyme for both steps as described in U.S. Pat. No. 5,322,770, or reverse transcribe mRNA into cDNA followed by symmetric gap ligase chain reaction (RT-AGLCR) as described by R. L. Marshall et al., *PCR Methods and Applications* 4: 80-84 (1994). Real time PCR may also be used.

Other known amplification methods which can be utilized herein include but are not limited to the so-called "NASBA" or "3SR" technique described in PNAS USA 87: 1874-1878 (1990) and also described in Nature 350 (No. 6313): 91-92 (1991); Q-beta amplification as described in published European Patent Application (EPA) No. 4544610; strand displacement amplification (as described in G. T. Walker et al., Clin. Chem. 42: 9-13 (1996) and European Patent Application No. 684315; target mediated amplification, as described by PCT Publication WO9322461; PCR; ligase chain reaction (LCR) (see, e.g., Wu and Wallace, Genomics 4, 560 (1989), Landegren et al., Science 241, 1077 (1988)); self-sustained sequence replication (SSR) (see, e.g., Guatelli et al., Proc. Nat. Acad. Sci. USA, 87, 1874 (1990)); and transcription amplification (see, e.g., Kwoh et al., Proc. Natl. Acad. Sci. USA 86, 1173 (1989)).

Many techniques are known in the state of the art for determining absolute and relative levels of gene expression, commonly used techniques suitable for use in the present invention include Northern analysis, RNase protection assays (RPA), microarrays and PCR-based techniques, such as quantitative PCR and differential display PCR. For example, Northern blotting involves running a preparation of RNA on a denaturing agarose gel, and transferring it to a suitable support, such as activated cellulose, nitrocellulose or glass or nylon membranes. Radiolabeled cDNA or RNA is then hybridized to the preparation, washed and analyzed by autoradiography.

In situ hybridization visualization may also be employed, wherein a radioactively labeled antisense RNA probe is hybridized with a thin section of a biopsy sample, washed, cleaved with RNase and exposed to a sensitive emulsion for autoradiography. The samples may be stained with hematoxylin to demonstrate the histological composition of the sample, and dark field imaging with a suitable light filter shows the developed emulsion. Non-radioactive labels such as digoxigenin may also be used.

Alternatively, mRNA expression can be detected on a DNA array, chip or a microarray. Labeled nucleic acids of a test sample obtained from a subject may be hybridized to a solid surface comprising biomarker DNA. Positive hybridization signal is obtained with the sample containing biomarker transcripts. Methods of preparing DNA arrays and their use are well-known in the art (see, e.g., U.S. Pat. Nos. 6,618,6796; 6,379,897; 6,664,377; 6,451,536; 548,257; U.S. 20030157485 and Schena et al. (1995) *Science* 20, 467-470; Gerhold et al. (1999) *Trends In Biochem. Sci.* 24, 168-173; and Lennon et al. (2000) *Drug Discovery Today* 5, 59-65, which are herein incorporated by reference in their entirety). Serial Analysis of Gene Expression (SAGE) can also be performed (See for example U.S. Patent Application 20030215858).

To monitor mRNA levels, for example, mRNA is extracted from the biological sample to be tested, reverse transcribed, and fluorescently-labeled cDNA probes are generated. The microarrays capable of hybridizing to marker cDNA are then probed with the labeled cDNA probes, the slides scanned and fluorescence intensity measured. This intensity correlates with the hybridization intensity and expression levels.

Types of probes that can be used in the methods described herein include cDNA, riboprobes, synthetic oligonucleotides and genomic probes. The type of probe used will generally be dictated by the particular situation, such as riboprobes for in situ hybridization, and cDNA for Northern blotting, for example. In one embodiment, the probe is directed to nucleotide regions unique to the RNA. The probes may be as short as is required to differentially recognize marker mRNA transcripts, and may be as short as, for example, 15 bases; however, probes of at least 17, 18, 19 or 20 or more bases can be used. In one embodiment, the primers and probes hybridize specifically under stringent conditions to a DNA fragment having the nucleotide sequence corresponding to the marker. As herein used, the term "stringent conditions" means hybridization will occur only if there is at least 95% identity in nucleotide sequences. In another embodiment, hybridization under "stringent conditions" occurs when there is at least 97% identity between the sequences.

The form of labeling of the probes may be any that is appropriate, such as the use of radioisotopes, for example, $^{32}P$ and $^{35}S$. Labeling with radioisotopes may be achieved, whether the probe is synthesized chemically or biologically, by the use of suitably labeled bases.

In one embodiment, the biological sample contains polypeptide molecules from the test subject. Alternatively, the biological sample can contain mRNA molecules from the test subject or genomic DNA molecules from the test subject.

In another embodiment, the methods further involve obtaining a control biological sample from a control subject, contacting the control sample with a compound or agent capable of detecting marker polypeptide, mRNA, genomic DNA, or fragments thereof, such that the presence of the marker polypeptide, mRNA, genomic DNA, or fragments thereof, is detected in the biological sample, and comparing the presence of the marker polypeptide, mRNA, genomic DNA, or fragments thereof, in the control sample with the presence of the marker polypeptide, mRNA, genomic DNA, or fragments thereof in the test sample.

3. Methods for Detection of Biomarker Protein Expression

The activity or level of a biomarker protein can be detected and/or quantified by detecting or quantifying the expressed polypeptide. The polypeptide can be detected and quantified by any of a number of means well-known to those of skill in the art. Aberrant levels of polypeptide expression of the polypeptides encoded by a biomarker nucleic acid and functionally similar homologs thereof, including a fragment or genetic alteration thereof (e.g., in regulatory or promoter regions thereof) are associated with the likelihood of response of a condition that would benefit from modulating an immune response to modulators of IRE1α-XBP1 pathway. Any method known in the art for detecting polypeptides can be used. Such methods include, but are not limited to, immunodiffusion, immunoelectrophoresis, radioimmunoassay (RIA), enzyme-linked immunosorbent assays (ELI- SAs), immunofluorescent assays, Western blotting, binder-ligand assays, immunohistochemical techniques, agglutination, complement assays, high performance liquid chromatography (HPLC), thin layer chromatography (TLC), hyperdiffusion chromatography, and the like (e.g., Basic and Clinical Immunology, Sites and Terr, eds., Appleton and Lange, Norwalk, Conn. pp 217-262, 1991 which is incorporated by reference). Preferred are binder-ligand immunoassay methods including reacting antibodies with an epitope or epitopes and competitively displacing a labeled polypeptide or derivative thereof.

For example, ELISA and RIA procedures may be conducted such that a desired biomarker protein standard is labeled (with a radioisotope such as $^{125}I$ or $^{35}S$, or an assayable enzyme, such as horseradish peroxidase or alkaline phosphatase), and, together with the unlabeled sample, brought into contact with the corresponding antibody, whereon a second antibody is used to bind the first, and radioactivity or the immobilized enzyme assayed (competitive assay). Alternatively, the biomarker protein in the sample is allowed to react with the corresponding immobilized antibody, radioisotope- or enzyme-labeled anti-biomarker protein antibody is allowed to react with the system, and radioactivity or the enzyme assayed (ELISA-sandwich assay). Other conventional methods may also be employed as suitable.

The above techniques may be conducted essentially as a "one-step" or "two-step" assay. A "one-step" assay involves contacting antigen with immobilized antibody and, without washing, contacting the mixture with labeled antibody. A "two-step" assay involves washing before contacting, the mixture with labeled antibody. Other conventional methods may also be employed as suitable.

In one embodiment, a method for measuring biomarker protein levels comprises the steps of: contacting a biological specimen with an antibody or variant (e.g., fragment) thereof which selectively binds the biomarker protein, and detecting whether said antibody or variant thereof is bound to said sample and thereby measuring the levels of the biomarker protein.

Enzymatic and radiolabeling of biomarker protein and/or the antibodies may be effected by conventional means. Such means will generally include covalent linking of the enzyme to the antigen or the antibody in question, such as by glutaraldehyde, specifically so as not to adversely affect the activity of the enzyme, by which is meant that the enzyme must still be capable of interacting with its substrate, although it is not necessary for all of the enzyme to be active, provided that enough remains active to permit the assay to be effected. Indeed, some techniques for binding enzyme are non-specific (such as using formaldehyde), and will only yield a proportion of active enzyme.

It is usually desirable to immobilize one component of the assay system on a support, thereby allowing other components of the system to be brought into contact with the component and readily removed without laborious and time-consuming labor. It is possible for a second phase to be immobilized away from the first, but one phase is usually sufficient.

It is possible to immobilize the enzyme itself on a support, but if solid-phase enzyme is required, then this is generally best achieved by binding to antibody and affixing the antibody to a support, models and systems for which are well-known in the art. Simple polyethylene may provide a suitable support.

Enzymes employable for labeling are not particularly limited, but may be selected from the members of the oxidase group, for example. These catalyze production of hydrogen peroxide by reaction with their substrates, and glucose oxidase is often used for its good stability, ease of availability and cheapness, as well as the ready availability of its substrate (glucose). Activity of the oxidase may be assayed by measuring the concentration of hydrogen peroxide formed after reaction of the enzyme-labeled antibody with the substrate under controlled conditions well-known in the art.

Other techniques may be used to detect biomarker protein according to a practitioner's preference based upon the present disclosure. One such technique is Western blotting (Towbin et at., *Proc. Nat. Acad. Sci.* 76:4350 (1979)), wherein a suitably treated sample is run on an SDS-PAGE gel before being transferred to a solid support, such as a nitrocellulose filter. Anti-biomarker protein antibodies (unlabeled) are then brought into contact with the support and assayed by a secondary immunological reagent, such as labeled protein A or anti-immunoglobulin (suitable labels including $^{125}I$, horseradish peroxidase and alkaline phosphatase). Chromatographic detection may also be used.

Immunohistochemistry may be used to detect expression of biomarker protein, e.g., in a biopsy sample. A suitable antibody is brought into contact with, for example, a thin layer of cells, washed, and then contacted with a second, labeled antibody. Labeling may be by fluorescent markers, enzymes, such as peroxidase, avidin, or radiolabeling. The assay is scored visually, using microscopy.

Anti-biomarker protein antibodies, such as intrabodies, may also be used for imaging purposes, for example, to detect the presence of biomarker protein in cells and tissues of a subject. Suitable labels include radioisotopes, iodine ($^{125}I$, $^{121}I$) carbon ($^{14}C$), sulphur ($^{35}S$), tritium ($^{3}H$), indium ($^{112}In$), and technetium ($^{99}mTc$), fluorescent labels, such as fluorescein and rhodamine, and biotin.

For in vivo imaging purposes, antibodies are not detectable, as such, from outside the body, and so must be labeled, or otherwise modified, to permit detection. Markers for this purpose may be any that do not substantially interfere with the antibody binding, but which allow external detection. Suitable markers may include those that may be detected by X-radiography, NMR or MRI. For X-radiographic techniques, suitable markers include any radioisotope that emits detectable radiation but that is not overtly harmful to the subject, such as barium or cesium, for example. Suitable markers for NMR and MRI generally include those with a detectable characteristic spin, such as deuterium, which may be incorporated into the antibody by suitable labeling of nutrients for the relevant hybridoma, for example.

The size of the subject, and the imaging system used, will determine the quantity of imaging moiety needed to produce diagnostic images. In the case of a radioisotope moiety, for a human subject, the quantity of radioactivity injected will normally range from about 5 to 20 millicuries of technetium-99. The labeled antibody or antibody fragment will then preferentially accumulate at the location of cells which contain biomarker protein. The labeled antibody or antibody fragment can then be detected using known techniques.

Antibodies that may be used to detect biomarker protein include any antibody, whether natural or synthetic, full length or a fragment thereof, monoclonal or polyclonal, that binds sufficiently strongly and specifically to the biomarker protein to be detected. An antibody may have a $K_d$ of at most about $10^{-6}$M, $10^{-7}$M, $10^{-8}$M, $10^{-9}$M, $10^{-10}$M, $10^{-11}$M, $10^{-12}$M. The phrase "specifically binds" refers to binding of, for example, an antibody to an epitope or antigen or antigenic determinant in such a manner that binding can be displaced or competed with a second preparation of identical or similar epitope, antigen or antigenic determinant. An antibody may bind preferentially to the biomarker protein relative to other proteins, such as related proteins.

Antibodies are commercially available or may be prepared according to methods known in the art.

Antibodies and derivatives thereof that may be used encompass polyclonal or monoclonal antibodies, chimeric, human, humanized, primatized (CDR-grafted), veneered or single-chain antibodies as well as functional fragments, i.e., biomarker protein binding fragments, of antibodies. For example, antibody fragments capable of binding to a biomarker protein or portions thereof, including, but not limited to, Fv, Fab, Fab' and F(ab') 2 fragments can be used. Such fragments can be produced by enzymatic cleavage or by recombinant techniques. For example, papain or pepsin cleavage can generate Fab or F(ab') 2 fragments, respectively. Other proteases with the requisite substrate specificity can also be used to generate Fab or F(ab') 2 fragments. Antibodies can also be produced in a variety of truncated forms using antibody genes in which one or more stop codons have been introduced upstream of the natural stop site. For example, a chimeric gene encoding a F(ab') 2 heavy chain portion can be designed to include DNA sequences encoding the CH, domain and hinge region of the heavy chain.

Synthetic and engineered antibodies are described in, e.g., Cabilly et al., U.S. Pat. No. 4,816,567 Cabilly et al., European Patent No. 0,125,023 B1; Boss et al., U.S. Pat. No. 4,816,397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Queen et al., European Patent No. 0451216 B1; and Padlan, E. A. et al., EP 0519596 A1. See also, Newman, R. et al., *BioTechnology,* 10: 1455-1460 (1992), regarding primatized antibody, and Ladner et al., U.S. Pat. No. 4,946,778 and Bird, R. E. et al., *Science,* 242: 423-426 (1988)) regarding single-chain antibodies. Antibodies produced from a library, e.g., phage display library, may also be used.

In some embodiments, agents that specifically bind to a biomarker protein other than antibodies are used, such as peptides. Peptides that specifically bind to a biomarker protein can be identified by any means known in the art. For example, specific peptide binders of a biomarker protein can be screened for using peptide phage display libraries.

4. Methods for Detection of Biomarker Structural Alterations

The following illustrative methods can be used to identify the presence of a structural alteration in a biomarker nucleic acid and/or biomarker polypeptide molecule in order to, for example, identify one or more biomarkers listed in Table 1, or other biomarkers used in the immunotherapies described herein.

In certain embodiments, detection of the alteration involves the use of a probe/primer in a polymerase chain reaction (PCR) (see, e.g., U.S. Pat. Nos. 4,683,195 and 4,683,202), such as anchor PCR or RACE PCR, or, alternatively, in a ligation chain reaction (LCR) (see, e.g., Landegran et al. (1988) *Science* 241:1077-1080; and Nakazawa et al. (1994) *Proc. Natl. Acad. Sci. USA* 91:360-364), the latter of which can be particularly useful for detecting point mutations in a biomarker nucleic acid such as a biomarker gene (see Abravaya et al. (1995) *Nucleic Acids Res.* 23:675-682). This method can include the steps of collecting a sample of cells from a subject, isolating nucleic acid (e.g., genomic, mRNA or both) from the cells of the sample, contacting the nucleic acid sample with one or more primers which specifically hybridize to a biomarker gene under conditions such that hybridization and amplification of the biomarker gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein.

Alternative amplification methods include: self-sustained sequence replication (Guatelli, J. C. et al. (1990) *Proc. Natl. Acad. Sci. USA* 87:1874-1878), transcriptional amplification system (Kwoh, D. Y. et al. (1989) *Proc. Natl. Acad. Sci. USA* 86:1173-1177), Q-Beta Replicase (Lizardi, P. M. et al. (1988) *Bio-Technology* 6:1197), or any other nucleic acid amplification method, followed by the detection of the amplified molecules using techniques well-known to those of skill in the art. These detection schemes are especially useful for the detection of nucleic acid molecules if such molecules are present in very low numbers.

In an alternative embodiment, mutations in a biomarker nucleic acid from a sample cell can be identified by alterations in restriction enzyme cleavage patterns. For example, sample and control DNA is isolated, amplified (optionally), digested with one or more restriction endonucleases, and fragment length sizes are determined by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in biomarker nucleic acid can be identified by hybridizing a sample and control nucleic acids, e.g., DNA or RNA, to high density arrays containing hundreds or thousands of oligonucleotide probes (Cronin, M. T. et al. (1996) *Hum. Mutat.* 7:244-255; Kozal, M. J. et al. (1996) *Nat. Med.* 2:753-759). For example, biomarker genetic mutations can be identified in two dimensional arrays containing light-generated DNA probes as described in Cronin et al. (1996) supra. Briefly, a first hybridization array of probes can be used to scan through long stretches of DNA in a sample and control to identify base changes between the sequences by making linear arrays of sequential, overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene. Such biomarker genetic mutations can be identified in a variety of contexts, including, for example, germline and somatic mutations.

In yet another embodiment, any of a variety of sequencing reactions known in the art can be used to directly sequence a biomarker gene and detect mutations by comparing the sequence of the sample biomarker with the corresponding wild-type (control) sequence. Examples of sequencing reactions include those based on techniques developed by Maxam and Gilbert (1977) *Proc. Natl. Acad. Sci. USA* 74:560 or Sanger (1977) *Proc. Natl. Acad Sci. USA* 74:5463. It is also contemplated that any of a variety of automated sequencing procedures can be utilized when performing the diagnostic assays (Naeve (1995) *Biotechniques* 19:448-53), including sequencing by mass spectrometry (see, e.g., PCT International Publication No. WO 94/16101; Cohen et al. (1996) *Adv. Chromatogr.* 36:127-162; and Griffin et al. (1993) *Appl. Biochem. Biotechnol.* 38:147-159).

Other methods for detecting mutations in a biomarker gene include methods in which protection from cleavage agents is used to detect mismatched bases in RNA/RNA or RNA/DNA heteroduplexes (Myers et al. (1985) *Science* 230:1242). In general, the art technique of "mismatch cleavage" starts by providing heteroduplexes formed by hybridizing (labeled) RNA or DNA containing the wild-type biomarker sequence with potentially mutant RNA or DNA obtained from a tissue sample. The double-stranded duplexes are treated with an agent which cleaves single-stranded regions of the duplex such as which will exist due to base pair mismatches between the control and sample strands. For instance, RNA/DNA duplexes can be treated with RNase and DNA/DNA hybrids treated with SI nuclease to enzymatically digest the mismatched regions. In other embodiments, either DNA/DNA or RNA/DNA duplexes can be treated with hydroxylamine or osmium tetroxide and with piperidine in order to digest mismatched regions. After digestion of the mismatched regions, the resulting material is then separated by size on denaturing polyacrylamide gels to determine the site of mutation. See, for example, Cotton et al. (1988) *Proc. Natl. Acad. Sci. USA* 85:4397 and Saleeba et al. (1992) *Methods Enzymol.* 217:286-295. In a preferred embodiment, the control DNA or RNA can be labeled for detection.

In still another embodiment, the mismatch cleavage reaction employs one or more proteins that recognize mismatched base pairs in double-stranded DNA (so called "DNA mismatch repair" enzymes) in defined systems for detecting and mapping point mutations in biomarker cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662). According to an exemplary embodiment, a probe based on a biomarker sequence, e.g., a wild-type biomarker treated with a DNA mismatch repair enzyme, and the cleavage products, if any, can be detected from electrophoresis protocols or the like (e.g., U.S. Pat. No. 5,459,039.)

In other embodiments, alterations in electrophoretic mobility can be used to identify mutations in biomarker genes. For example, single strand conformation polymorphism (SSCP) may be used to detect differences in electrophoretic mobility between mutant and wild type nucleic acids (Orita et al. (1989) *Proc Natl. Acad. Sci USA* 86:2766; see also Cotton (1993) *Mutat. Res.* 285:125-144 and Hayashi (1992) *Genet. Anal. Tech. Appl.* 9:73-79). Single-stranded DNA fragments of sample and control biomarker nucleic acids will be denatured and allowed to renature. The secondary structure of single-stranded nucleic acids varies according to sequence, the resulting alteration in electrophoretic mobility enables the detection of even a single base change. The DNA fragments may be labeled or detected with labeled probes. The sensitivity of the assay may be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment the movement of mutant or wild-type fragments in polyacrylamide gels containing a gradient of denaturant is assayed using denaturing gradient gel electrophoresis (DGGE) (Myers et al. (1985) *Nature* 313:495). When DGGE is used as the method of analysis, DNA will be modified to ensure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys. Chem.* 265:12753).

Examples of other techniques for detecting point mutations include, but are not limited to, selective oligonucleotide hybridization, selective amplification, or selective primer extension. For example, oligonucleotide primers may be prepared in which the known mutation is placed centrally and then hybridized to target DNA under conditions which permit hybridization only if a perfect match is found (Saiki et al. (1986) *Nature* 324:163; Saiki et al. (1989) *Proc. Natl. Acad. Sci. USA* 86:6230). Such allele specific oligonucleotides are hybridized to PCR amplified target DNA or a number of different mutations when the oligonucleotides are attached to the hybridizing membrane and hybridized with labeled target DNA.

Alternatively, allele specific amplification technology which depends on selective PCR amplification may be used in conjunction with the instant invention. Oligonucleotides used as primers for specific amplification may carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell Probes* 6:1). It is anticipated that in certain embodiments amplification may also be performed using Taq ligase for amplification (Barany (1991) *Proc. Natl. Acad. Sci USA* 88:189). In such cases, ligation will occur only if there is a perfect match at the 3' end of the 5' sequence making it possible to detect the presence of a known mutation at a specific site by looking for the presence or absence of amplification.

III. Subjects

In one embodiment, the subject for whom a cancer vaccine comprising cancer cells, wherein the cancer cells are (1) PTEN-deficient, (2) p53-deficient, and (3) modified to activate TGFβ-Smad/p63 signaling pathway is administered, or whose predicted likelihood of efficacy of the cancer vaccine for treating a cancer is determined, is a mammal (e.g., rat, primate, non-human mammal, domestic animal, such as a dog, cat, cow, horse, and the like), and is preferably a human. In another embodiment, the subject is an animal model of cancer. For example, the animal model can be an orthotopic xenograft animal model of a human-derived cancer or allograft of syngeneic cancer models.

In another embodiment of the methods of the present invention, the subject has not undergone treatment, such as chemotherapy, radiation therapy, targeted therapy, and/or immunotherapies. In still another embodiment, the subject has undergone treatment, such as chemotherapy, radiation therapy, targeted therapy, and/or immunotherapies. In yet another embodiment, the subject is previously has the cancer and/or in remission for the cancer.

In certain embodiments, the subject has had surgery to remove cancerous or precancerous tissue. In other embodiments, the cancerous tissue has not been removed, e.g., the cancerous tissue may be located in an inoperable region of the body, such as in a tissue that is essential for life, or in a region where a surgical procedure would cause considerable risk of harm to the patient.

The methods of the present invention can be used to determine the responsiveness to the cancer vaccine for treating a cancer.

IV. Methods of Treatment

The present invention provides for both prophylactic and therapeutic methods of treating a subject at risk of (or susceptible to) a cancer. The cancer may be a solid or hematological cancer. In one embodiment, the cancer is the same cancer type with the same genetic mutations as the cancer vaccine. In another embodiment, the cancer is a different cancer type from the cancer vaccine but has the same genetic mutations (e.g., co-loss of p53 and PTEN). In still another embodiment, the cancer is the same cancer type as the cancer vaccine with different genetic mutations. In yet another embodiment, the cancer is a different cancer type the cancer vaccine with different genetic mutations. For example, the cancer may be a PPA tumor (a very aggressive breast cancer characterized by triple loss of p53, PTEN, and p110α), C260 tumor (a high grade serous ovarian cancer drived by p53/PTEN co-loss and high Myc expression), D658 (a Kras mutated recurrent breast cancer cell model generated from a $PIK3CA^{H1047R}$ GEMM of breast cancer), or d333 (a glioblastoma tumor model derived from p53 and PTEN co-loss GEMM).

a. Prophylactic Methods

In one aspect, the present invention provides a method for preventing a subject afflicted with cancer, by administering to the subject a therapeutically effective amount of a cancer vaccine comprising cancer cells, wherein the cancer cells are (1) PTEN-deficient, (2) p53-deficient, and (3) modified to activate the TGFβ-Smad/p63 signaling pathway. Administration of a prophylactic agent (e.g., the cancer vaccine described herein) can occur prior to the manifestation of symptoms characteristic of cancer, such that a cancer is prevented or, alternatively, delayed in its progression. In certain embodiments, administration of the prophylactic agent (e.g., the cancer vaccine described herein) protects the subject from recurrent cancer.

b. Therapeutic Methods

Another aspect of the present invention pertains to methods treating a subject afflicted with cancer, by administering to the subject a therapeutically effective amount of a cancer vaccine comprising cancer cells, wherein the cancer cells are (1) PTEN-deficient, (2) p53-deficient, and (3) modified to activate the TGFβ-Smad/p63 signaling pathway.

As described below and in some embodiments, a cancer vaccine comprising cancer cells, wherein the cancer cells are (1) PTEN-deficient, (2) p53-deficient, and (3) modified to activate the TGFβ-Smad/p63 signaling pathway, is administered to a subject. Thus, the cancer cells will have an immunocompatibility relationship to the subject host and any such relationship is contemplated for use according to the present invention. For example, the cancer cells can be syngeneic. The term "syngeneic" can refer to the state of deriving from, originating in, or being members of the same species that are genetically identical, particularly with respect to antigens or immunological reactions. These include identical twins having matching MHC types. Thus, a "syngeneic transplant" refers to transfer of cells from a donor to a recipient who is genetically identical to the donor or is sufficiently immunologically compatible as to allow for transplantation without an undesired adverse immunogenic response (e.g., such as one that would work against interpretation of immunological screen results described herein).

A syngeneic transplant can be "autologous" if the transferred cells are obtained from and transplanted to the same subject. An "autologous transplant" refers to the harvesting and reinfusion or transplant of a subject's own cells or organs. Exclusive or supplemental use of autologous cells may eliminate or reduce many adverse effects of administration of the cells back to the host, particular graft versus host reaction.

A syngeneic transplant can be "matched allogeneic" if the transferred cells are obtained from and transplanted to different members of the same species yet have sufficiently matched major histocompatibility complex (MHC) antigens to avoid an adverse immunogenic response. Determining the degree of MHC mismatch may be accomplished according to standard tests known and used in the art. For instance, there are at least six major categories of MHC genes in humans, identified as being important in transplant biology. HLA-A, HLA-B, HLA-C encode the HLA class I proteins while HLA-DR, HLA-DQ, and HLA-DP encode the HLA class II proteins. Genes within each of these groups are highly polymorphic, as reflected in the numerous HLA alleles or variants found in the human population, and differences in these groups between individuals is associated with the strength of the immune response against transplanted cells. Standard methods for determining the degree of MHC match examine alleles within HLA-B and HLA-DR, or HLA-A, HLA-B and HLA-DR groups. Thus, tests may be made of at least 4, and even 5 or 6 MHC antigens within the two or three HLA groups, respectively. In serological MEC tests, antibodies directed against each HLA antigen type are reacted with cells from one subject (e.g., donor) to determine the presence or absence of certain MHC antigens that react with the antibodies. This is compared to the reactivity profile of the other subject (e.g., recipient). Reaction of the antibody with an MHC antigen is typically determined by incubating the antibody with cells, and then adding complement to induce cell lysis (i.e., lymphocytotoxicity testing). The reaction is examined and graded according to the amount of cells lysed in the reaction (see, for example, Mickelson and Petersdorf (1999) *Hematopoietic Cell Transplantation*, Thomas, E. D. et al. eds., pg 28-37, Blackwell Scientific, Malden, Mass.). Other cell-based assays include flow cytometry using labeled antibodies or enzyme linked immunoassays (ELISA). Molecular methods for determining MHC type are well-known and generally employ synthetic probes and/or primers to detect specific gene sequences that encode the HLA protein. Synthetic oligonucleotides may be used as hybridization probes to detect restriction fragment length polymorphisms associated with particular HLA types (Vaughn (2002) *Method. Mol. Biol. MHC Protocol.* 210:45-60). Alternatively, primers may be used for amplifying the HLA sequences (e.g., by polymerase chain reaction or ligation chain reaction), the products of which may be further examined by direct DNA sequencing, restriction fragment polymorphism analysis (RFLP), or hybridization with a series of sequence specific oligonucleotide primers (SSOP) (Petersdorf et al. (1998) *Blood* 92:3515-3520; Morishima et al. (2002) *Blood* 99:4200-4206; and Middleton and Williams (2002) *Method. Mol. Biol. MHC Protocol.* 210:67-112).

A syngeneic transplant can be "congenic" if the transferred cells and cells of the subject differ in defined loci, such as a single locus, typically by inbreeding. The term "congenic" refers to deriving from, originating in, or being members of the same species, where the members are genetically identical except for a small genetic region, typically a single genetic locus (i.e., a single gene). A "congenic transplant" refers to transfer of cells or organs from a donor to a recipient, where the recipient is genetically identical to the donor except for a single genetic locus. For example, CD45 exists in several allelic forms and congenic mouse lines exist in which the mouse lines differ with respect to whether the CD45.1 or CD45.2 allelic versions are expressed.

By contrast, "mismatched allogeneic" refers to deriving from, originating in, or being members of the same species having non-identical major histocompatibility complex (MHC) antigens (i.e., proteins) as typically determined by standard assays used in the art, such as serological or molecular analysis of a defined number of MHC antigens, sufficient to elicit adverse immunogenic responses. A "partial mismatch" refers to partial match of the MHC antigens tested between members, typically between a donor and recipient. For instance, a "half mismatch" refers to 50% of the MHC antigens tested as showing different MHC antigen type between two members. A "full" or "complete" mismatch refers to all MHC antigens tested as being different between two members.

Similarly, in contrast, "xenogeneic" refers to deriving from, originating in, or being members of different species, e.g., human and rodent, human and swine, human and chimpanzee, etc. A "xenogeneic transplant" refers to transfer of cells or organs from a donor to a recipient where the recipient is a species different from that of the donor.

In addition, cancer cells can be obtained from a single source or a plurality of sources (e.g., a single subject or a plurality of subjects). A plurality refers to at least two (e.g., more than one). In still another embodiment, the non-human mammal is a mouse. The animals from which cell types of interest are obtained may be adult, newborn (e.g., less than 48 hours old), immature, or in utero. Cell types of interest may be primary cancer cells, cancer stem cells, established cancer cell lines, immortalized primary cancer cells, and the like. In certain embodiments, the immune systems of host subjects can be engineered or otherwise elected to be immunological compatible with transplanted cancer cells. For example, in one embodiment, the subject may be "humanized" in order to be compatible with human cancer cells. The term "immune-system humanized" refers to an animal, such as a mouse, comprising human HSC lineage cells and human acquired and innate immune cells, survive without being rejected from the host animal, thereby allowing human hematopoiesis and both acquired and innate immunity to be reconstituted in the host animal. Acquired immune cells include T cells and B cells. Innate immune cells include macrophages, granulocytes (basophils, eosinophils, neutrophils), DCs, NK cells and mast cells. Representative, non-limiting examples include SCID-hu, Hu-PBL-SCID, Hu-SRC-SCID, NSG (NOD-SCID IL2r-gamma(null) lack an innate immune system, B cells, T cells, and cytokine signaling), NOG (NOD-SCID IL2r-gamma (truncated)), BRG (BALB/c-Rag2(null)IL2r-gamma(null)), and H2dRG (Stock-H2d-Rag2(null)IL2r-gamma(null)) mice (see, for example, Shultz et al. (2007) *Nat. Rev. Immunol.* 7:118; Pearson et al. (2008) *Curr. Protocol. Immunol.* 15:21; Brehm et al (2010) *Clin. Immunol.* 135:84-98; McCune et al. (1988) *Science* 241:1632-1639, U.S. Pat. No. 7,960,175, and U.S. Pat. Publ. 2006/0161996), as well as related null mutants of immune-related genes like Rag1 (lack B and T cells), Rag2 (lack B and T cells), TCR alpha (lack T cells), perforin (cD8+ T cells lack cytotoxic function), FoxP3 (lack functional CD4+ T regulatory cells), IL2rg, or Prfl, as well as mutants or knockouts of PD-1, PD-L1, Tim3, and/or 2B4, allow for efficient engraftment of human immune cells in and/or provide compartment-specific models of immunocompromised animals like mice (see, for example, PCT Publ. WO2013/062134). In addition, NSG-CD34+ (NOD-SCID IL2r-gamma(null) CD34+) humanized mice are useful for studying human gene and tumor activity in animal models like mice.

As used herein, "obtained" from a biological material source means any conventional method of harvesting or partitioning a source of biological material from a donor. For example, biological material may obtained from a solid tumor, a blood sample, such as a peripheral or cord blood sample, or harvested from another body fluid, such as bone marrow or amniotic fluid. Methods for obtaining such samples are well-known to the artisan. In the present invention, the samples may be fresh (i.e., obtained from a donor without freezing). Moreover, the samples may be further manipulated to remove extraneous or unwanted components prior to expansion. The samples may also be obtained from a preserved stock. For example, in the case of cell lines or fluids, such as peripheral or cord blood, the samples may be withdrawn from a cryogenically or otherwise preserved bank of such cell lines or fluid. Such samples may be obtained from any suitable donor.

The obtained populations of cells may be used directly or frozen for use at a later date. A variety of mediums and protocols for cryopreservation are known in the art. Generally, the freezing medium will comprise DMSO from about 5-10%, 10-90% serum albumin, and 50-90% culture medium. Other additives useful for preserving cells include, by way of example and not limitation, disaccharides such as trehalose (Scheinkonig et al. (2004) *Bone Marrow Transplant.* 34:531-536), or a plasma volume expander, such as hetastarch (i.e., hydroxyethyl starch). In some embodiments, isotonic buffer solutions, such as phosphate-buffered saline, may be used. An exemplary cryopreservative composition has cell-culture medium with 4% HSA, 7.5% dimethyl sulfoxide (DMSO), and 2% hetastarch. Other compositions and methods for cryopreservation are well-known and described in the art (see, e.g., Broxmeyer et al. (2003) *Proc. Natl. Acad. Sci. U.S.A.* 100:645-650). Cells are preserved at a final temperature of less than about −135° C.

c. Combination Therapy

The cancer vaccine can be administered in combination therapy with, e.g., chemotherapeutic agents, hormones, antiangiogens, radiolabelled, compounds, or with surgery, cryotherapy, and/or radiotherapy. The preceding treatment methods can be administered in conjunction with other forms of conventional therapy (e.g., standard-of-care treatments for cancer well-known to the skilled artisan), either consecutively with, pre- or post-conventional therapy. For example, the cancer vaccine can be administered with a therapeutically effective dose of chemotherapeutic agent. In another embodiment, the cancer vaccine is administered in conjunction with chemotherapy to enhance the activity and efficacy of the chemotherapeutic agent. The Physicians' Desk Reference (PDR) discloses dosages of chemotherapeutic agents that have been used in the treatment of various cancers. The dosing regimen and dosages of these aforementioned chemotherapeutic drugs that are therapeutically effective will depend on the particular cancer being treated, the extent of the disease and other factors familiar to the physician of skill in the art, and can be determined by the physician.

The cancer vaccine can also be administered in combination with targeted therapy, e.g., immunotherapy. The term "targeted therapy" refers to administration of agents that selectively interact with a chosen biomolecule to thereby treat cancer. For example, targeted therapy regarding the inhibition of immune checkpoint inhibitor is useful in combination with the methods of the present invention. The term "immune checkpoint inhibitor" means a group of molecules on the cell surface of CD4+ and/or CD8+ T cells that fine-tune immune responses by down-modulating or inhibiting an anti-tumor immune response. Immune checkpoint proteins are well-known in the art and include, without limitation, CTLA-4, PD-1, VISTA, B7-H2, B7-H3, PD-L1, B7-H4, B7-H6, 2B4, ICOS, HVEM, PD-L2, CD160, gp49B, PIR-B, KM family receptors, TIM-1, TIM-3, TIM-4, LAG-3, BTLA, SIRPalpha (CD47), CD48, 2B4 (CD244), B7.1, B7.2, ILT-2, ILT-4, TIGIT, and A2aR (see, for example, WO 2012/177624). Inhibition of one or more immune checkpoint inhibitors can block or otherwise neutralize inhibitory signaling to thereby upregulate an immune response in order to more efficaciously treat cancer. In some embodiments, the cancer vaccine is administered in combination with one or more inhibitors of immune checkpoints, such as PD1, PD-L1, and/or CD47 inhibitors.

Immunotherapy is one form of targeted therapy that may comprise, for example, the use of additional cancer vaccines and/or sensitized antigen presenting cells. For example, an oncolytic virus is a virus that is able to infect and lyse cancer cells, while leaving normal cells unharmed, making them potentially useful in cancer therapy. Replication of oncolytic viruses both facilitates tumor cell destruction and also produces dose amplification at the tumor site. They may also act as vectors for anticancer genes, allowing them to be specifically delivered to the tumor site. The immunotherapy can involve passive immunity for short-term protection of a host, achieved by the administration of pre-formed antibody directed against a cancer antigen or disease antigen (e.g., administration of a monoclonal antibody, optionally linked to a chemotherapeutic agent or toxin, to a tumor antigen). For example, anti-VEGF and mTOR inhibitors are known to be effective in treating renal cell carcinoma. Immunotherapy can also focus on using the cytotoxic lymphocyte-recognized epitopes of cancer cell lines. Alternatively, antisense polynucleotides, ribozymes, RNA interference molecules, triple helix polynucleotides and the like, can be used to selectively modulate biomolecules that are linked to the initiation, progression, and/or pathology of a tumor or cancer.

The term "untargeted therapy" refers to administration of agents that do not selectively interact with a chosen biomolecule yet treat cancer. Representative examples of untargeted therapies include, without limitation, chemotherapy, gene therapy, and radiation therapy.

In one embodiment, chemotherapy is used. Chemotherapy includes the administration of a chemotherapeutic agent. Such a chemotherapeutic agent may be, but is not limited to, those selected from among the following groups of compounds: platinum compounds, cytotoxic antibiotics, antimetabolities, anti-mitotic agents, alkylating agents, arsenic compounds, DNA topoisomerase inhibitors, taxanes, nucleoside analogues, plant alkaloids, and toxins; and synthetic derivatives thereof. Exemplary compounds include, but are not limited to, alkylating agents: cisplatin, treosulfan, and trofosfamide; plant alkaloids: vinblastine, paclitaxel, docetaxol; DNA topoisomerase inhibitors: teniposide, crisnatol, and mitomycin; anti-folates: methotrexate, mycophenolic acid, and hydroxyurea; pyrimidine analogs: 5-fluorouracil, doxifluridine, and cytosine arabinoside; purine analogs: mercaptopurine and thioguanine; DNA antimetabolites: 2'-deoxy-5-fluorouridine, aphidicolin glycinate, and pyrazoloimidazole; and antimitotic agents: halichondrin, colchicine, and rhizoxin. Compositions comprising one or more chemotherapeutic agents (e.g., FLAG, CHOP) may also be used. FLAG comprises fludarabine, cytosine arabinoside (Ara-C) and G-CSF. CHOP comprises cyclophosphamide, vincristine, doxorubicin, and prednisone. The foregoing examples of chemotherapeutic agents are illustrative, and are not intended to be limiting.

In another embodiment, radiation therapy is used. The radiation used in radiation therapy can be ionizing radiation. Radiation therapy can also be gamma rays, X-rays, or proton beams. Examples of radiation therapy include, but are not limited to, external-beam radiation therapy, interstitial implantation of radioisotopes (I-125, palladium, iridium), radioisotopes such as strontium-89, thoracic radiation therapy, intraperitoneal P-32 radiation therapy, and/or total abdominal and pelvic radiation therapy. For a general overview of radiation therapy, see Hellman, Chapter 16: Principles of Cancer Management: Radiation Therapy, 6th edition, 2001, DeVita et al., eds., J. B. Lippencott Company, Philadelphia. The radiation therapy can be administered as external beam radiation or teletherapy wherein the radiation is directed from a remote source. The radiation treatment can also be administered as internal therapy or brachytherapy wherein a radioactive source is placed inside the body close to cancer cells or a tumor mass. Also encompassed is the use of photodynamic therapy comprising the administration of photosensitizers, such as hematoporphyrin and its derivatives, Vertoporfin (BPD-MA), phthalocyanine, photosensitizer Pc4, demethoxy-hypocrellin A; and 2BA-2-DMHA.

In another embodiment, hormone therapy is used. Hormonal therapeutic treatments can comprise, for example, hormonal agonists, hormonal antagonists (e.g., flutamide, bicalutamide, tamoxifen, raloxifene, leuprolide acetate (LUPRON), LH-RH antagonists), inhibitors of hormone biosynthesis and processing, and steroids (e.g., dexamethasone, retinoids, deltoids, betamethasone, cortisol, cortisone, prednisone, dehydrotestosterone, glucocorticoids, mineralocorticoids, estrogen, testosterone, progestins), vitamin A derivatives (e.g., all-trans retinoic acid (ATRA)); vitamin D3 analogs; antigestagens (e.g., mifepristone, onapristone), or antiandrogens (e.g., cyproterone acetate).

In another embodiment, hyperthermia, a procedure in which body tissue is exposed to high temperatures (up to 106° F.) is used. Heat may help shrink tumors by damaging cells or depriving them of substances they need to live. Hyperthermia therapy can be local, regional, and whole-body hyperthermia, using external and internal heating devices. Hyperthermia is almost always used with other forms of therapy (e.g., radiation therapy, chemotherapy, and biological therapy) to try to increase their effectiveness. Local hyperthermia refers to heat that is applied to a very small area, such as a tumor. The area may be heated externally with high-frequency waves aimed at a tumor from a device outside the body. To achieve internal heating, one of several types of sterile probes may be used, including thin, heated wor hollow tubes filled with warm water; implanted microwave antennae; and radiofrequency electrodes. In regional hyperthermia, an organ or a limb is heated. Magnets and devices that produce high energy are placed over the region to be heated. In another approach, called perfusion, some of the patient's blood is removed, heated, and then pumped (perfused) into the region that is to be heated internally. Whole-body heating is used to treat metastatic cancer that has spread throughout the body. It can be accomplished using warm-water blankets, hot wax, inductive coils (like those in electric blankets), or thermal chambers (similar to large incubators). Hyperthermia does not cause any marked increase in radiation side effects or complications. Heat applied directly to the skin, however, can cause discomfort or even significant local pain in about half the patients treated. It can also cause blisters, which generally heal rapidly.

In still another embodiment, photodynamic therapy (also called PDT, photoradiation therapy, phototherapy, or photochemotherapy) is used for the treatment of some types of cancer. It is based on the discovery that certain chemicals known as photosensitizing agents can kill one-celled organisms when the organisms are exposed to a particular type of light. PDT destroys cancer cells through the use of a fixed-frequency laser light in combination with a photosensitizing agent. In PDT, the photosensitizing agent is injected into the bloodstream and absorbed by cells all over the body. The agent remains in cancer cells for a longer time than it does in normal cells. When the treated cancer cells are exposed to laser light, the photosensitizing agent absorbs the light and produces an active form of oxygen that destroys the treated cancer cells. Light exposure must be timed carefully so that it occurs when most of the photosensitizing agent has left healthy cells but is still present in the cancer cells. The laser light used in PDT can be directed through a fiber-optic (a very thin glass strand). The fiber-optic is placed close to the cancer to deliver the proper amount of light. The fiber-optic can be directed through a bronchoscope into the lungs for the treatment of lung cancer or through an endoscope into the esophagus for the treatment of esophageal cancer. An advantage of PDT is that it causes minimal damage to healthy tissue. However, because the laser light currently in use cannot pass through more than about 3 centimeters of tissue (a little more than one and an eighth inch), PDT is mainly used to treat tumors on or just under the skin or on the lining of internal organs. Photodynamic therapy makes the skin and eyes sensitive to light for 6 weeks or more after treatment. Patients are advised to avoid direct sunlight and bright indoor light for at least 6 weeks. If patients must go outdoors, they need to wear protective clothing, including sunglasses. Other temporary side effects of PDT are related to the treatment of specific areas and can include coughing, trouble swallowing, abdominal pain, and painful breathing or shortness of breath. In December 1995, the U.S. Food and Drug Administration (FDA) approved a photosensitizing agent called porfimer sodium, or Photofrin®, to relieve symptoms of esophageal cancer that is causing an obstruction and for esophageal cancer that cannot be satisfactorily treated with lasers alone. In January 1998, the FDA approved porfimer sodium for the treatment of early non-small cell lung cancer in patients for whom the usual treatments for lung cancer are not appropriate. The National Cancer Institute and other institutions are supporting clinical trials (research studies) to evaluate the use of photodynamic therapy for several types of cancer, including cancers of the bladder, brain, larynx, and oral cavity.

In yet another embodiment, laser therapy is used to harness high-intensity light to destroy cancer cells. This technique is often used to relieve symptoms of cancer such as bleeding or obstruction, especially when the cancer cannot be cured by other treatments. It may also be used to treat cancer by shrinking or destroying tumors. The term “laser” stands for light amplification by stimulated emission of radiation. Ordinary light, such as that from a light bulb, has many wavelengths and spreads in all directions. Laser light, on the other hand, has a specific wavelength and is focused in a narrow beam. This type of high-intensity light contains a lot of energy. Lasers are very powerful and may be used to cut through steel or to shape diamonds. Lasers also can be used for very precise surgical work, such as repairing a damaged retina in the eye or cutting through tissue (in place of a scalpel). Although there are several different kinds of lasers, only three kinds have gained wide use in medicine: Carbon dioxide ($CO_2$) laser—This type of laser can remove thin layers from the skin’s surface without penetrating the deeper layers. This technique is particularly useful in treating tumors that have not spread deep into the skin and certain precancerous conditions. As an alternative to traditional scalpel surgery, the $CO_2$ laser is also able to cut the skin. The laser is used in this way to remove skin cancers. Neodymium:yttrium-aluminum-garnet (Nd:YAG) laser—Light from this laser can penetrate deeper into tissue than light from the other types of lasers, and it can cause blood to clot quickly. It can be carried through optical fibers to less accessible parts of the body. This type of laser is sometimes used to treat throat cancers. Argon laser—This laser can pass through only superficial layers of tissue and is therefore useful in dermatology and in eye surgery. It also is used with light-sensitive dyes to treat tumors in a procedure known as photodynamic therapy (PDT). Lasers have several advantages over standard surgical tools, including: Lasers are more precise than scalpels. Tissue near an incision is protected, since there is little contact with surrounding skin or other tissue. The heat produced by lasers sterilizes the surgery site, thus reducing the risk of infection. Less operating time may be needed because the precision of the laser allows for a smaller incision. Healing time is often shortened; since laser heat seals blood vessels, there is less bleeding, swelling, or scarring. Laser surgery may be less complicated. For example, with fiber optics, laser light can be directed to parts of the body without making a large incision. More procedures may be done on an outpatient basis. Lasers can be used in two ways to treat cancer: by shrinking or destroying a tumor with heat, or by activating a chemical—known as a photosensitizing agent—that destroys cancer cells. In PDT, a photosensitizing agent is retained in cancer cells and can be stimulated by light to cause a reaction that kills cancer cells. $CO_2$ and Nd:YAG lasers are used to shrink or destroy tumors. They may be used with endoscopes, tubes that allow physicians to see into certain areas of the body, such as the bladder. The light from some lasers can be transmitted through a flexible endoscope fitted with fiber optics. This allows physicians to see and work in parts of the body that could not otherwise be reached except by surgery and therefore allows very precise aiming of the laser beam. Lasers also may be used with low-power microscopes, giving the doctor a clear view of the site being treated. Used with other instruments, laser systems can produce a cutting area as small as 200 microns in diameter—less than the width of a very fine thread. Lasers are used to treat many types of cancer. Laser surgery is a standard treatment for certain stages of glottis (vocal cord), cervical, skin, lung, vaginal, vulvar, and penile cancers. In addition to its use to destroy the cancer, laser surgery is also used to help relieve symptoms caused by cancer (palliative care). For example, lasers may be used to shrink or destroy a tumor that is blocking a patient’s trachea (windpipe), making it easier to breathe. It is also sometimes used for palliation in colorectal and anal cancer. Laser-induced interstitial thermotherapy (LITT) is one of the most recent developments in laser therapy. LITT uses the same idea as a cancer treatment called hyperthermia; that heat may help shrink tumors by damaging cells or depriving them of substances they need to live. In this treatment, lasers are directed to interstitial areas (areas between organs) in the body. The laser light then raises the temperature of the tumor, which damages or destroys cancer cells.

The immunotherapy and/or cancer therapy may be administered before, after, or concurrently with the cancer vaccine described herein. The duration and/or dose of treatment with the cancer vaccine may vary according to the particular cancer vaccine, or the particular combinatory therapy. An appropriate treatment time for a particular cancer therapeutic agent will be appreciated by the skilled artisan. The invention contemplates the continued assessment of optimal treatment schedules for each cancer therapeutic agent, where the phenotype of the cancer of the subject as determined by the methods of the invention is a factor in determining optimal treatment doses and schedules.

V. Clinical Efficacy

Clinical efficacy can be measured by any method known in the art. For example, the response to an cancer therapy (e.g., a cancer vaccine comprising cancer cells, wherein the cancer cells are (1) PTEN-deficient, (2) p53-deficient, and (3) modified to activate the TGFβ-Samd/p63 signaling pathway), relates to any response of the cancer, e.g., a tumor, to the therapy, preferably to a change in tumor mass and/or volume after initiation of neoadjuvant or adjuvant chemotherapy. Tumor response may be assessed in a neoadjuvant or adjuvant situation where the size of a tumor after systemic intervention can be compared to the initial size and dimensions as measured by CT, PET, mammogram, ultrasound or palpation and the cellularity of a tumor can be estimated histologically and compared to the cellularity of a tumor biopsy taken before initiation of treatment. Response may also be assessed by caliper measurement or pathological examination of the tumor after biopsy or surgical resection. Response may be recorded in a quantitative fashion like percentage change in tumor volume or cellularity or using a semi-quantitative scoring system such as residual cancer burden (Symmans et al. (2007) *J. Clin. Oncol.* 25:4414-4422) or Miller-Payne score (Ogston et al. (2003) *Breast* (Edinburgh, Scotland) 12:320-327) in a qualitative fashion like "pathological complete response" (pCR), "clinical complete remission" (cCR), "clinical partial remission" (cPR), "clinical stable disease" (cSD), "clinical progressive disease" (cPD) or other qualitative criteria. Assessment of tumor response may be performed early after the onset of neoadjuvant or adjuvant therapy, e.g., after a few hours, days, weeks or preferably after a few months. A typical endpoint for response assessment is upon termination of neoadjuvant chemotherapy or upon surgical removal of residual tumor cells and/or the tumor bed.

In some embodiments, clinical efficacy of the therapeutic treatments described herein may be determined by measuring the clinical benefit rate (CBR). The clinical benefit rate is measured by determining the sum of the percentage of patients who are in complete remission (CR), the number of patients who are in partial remission (PR) and the number of patients having stable disease (SD) at a time point at least 6 months out from the end of therapy. The shorthand for this formula is CBR=CR+PR+SD over 6 months. In some embodiments, the CBR for a particular cancer vaccine therapeutic regimen is at least 25%, 30%, 35%, 40%, 45%, 50%, 55%, 60%, 65%, 70%, 75%, 80%, 85%, or more.

Additional criteria for evaluating the response to cancer therapy (e.g., a cancer vaccine comprising cancer cells, wherein the cancer cells are (1) PTEN-deficient, (2) p53-deficient, and (3) modified to activate the TGFβ-Samd/p63 signaling pathway) are related to "survival," which includes all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g., time of diagnosis or start of treatment) and end point (e.g., death, recurrence or metastasis). In addition, criteria for efficacy of treatment can be expanded to include response to chemotherapy, probability of survival, probability of metastasis within a given time period, and probability of tumor recurrence.

For example, in order to determine appropriate threshold values, a particular agent encompassed by the present invention can be administered to a population of subjects and the outcome can be correlated to biomarker measurements that were determined prior to administration of any cancer therapy (e.g., a cancer vaccine comprising cancer cells, wherein the cancer cells are (1) PTEN-deficient, (2) p53-deficient, and (3) modified to activate the TGFβ-Samd/p63 signaling pathway). The outcome measurement may be pathologic response to therapy given in the neoadjuvant setting. Alternatively, outcome measures, such as overall survival and disease-free survival can be monitored over a period of time for subjects following cancer therapy (e.g., a cancer vaccine comprising cancer cells, wherein the cancer cells are (1) PTEN-deficient, (2) p53-deficient, and (3) modified to activate the TGFβ-Samd/p63 signaling pathway) for whom biomarker measurement values are known. In certain embodiments, the same doses of the agent are administered to each subject. In related embodiments, the doses administered are standard doses known in the art for the agent. The period of time for which subjects are monitored can vary. For example, subjects may be monitored for at least 2, 4, 6, 8, 10, 12, 14, 16, 18, 20, 25, 30, 35, 40, 45, 50, 55, or 60 months. Biomarker measurement threshold values that correlate to outcome of a cancer therapy (e.g., a cancer vaccine comprising cancer cells, wherein the cancer cells are (1) PTEN-deficient, (2) p53-deficient, and (3) modified to activate the TGFβ-Samd/p63 signaling pathway) can be determined using methods such as those described in the Examples section.

VI. Pharmaceutical Compositions and Administration

For cancer vaccine of present invention, cancer cells can be administered at 1, 10, 1000, 10,000, $0.1\times10^6$, $0.2\times10^6$, $0.3\times10^6$, $0.4\times10^6$, $0.5\times10^6$, $0.6\times10^6$, $0.7\times10^6$, $0.8\times10^6$, $0.9\times10^6$, $1.0\times10^6$, $5.0\times10^6$, $1.0\times10^7$, $5.0\times10^7$, $1.0\times10^8$, $5.0\times10^8$, $1.0\times10^9$ or more, or any range in between or any value in between, cells per kilogram of subject body weight. The number of cells transplanted may be adjusted based on the desired level of engraftment in a given amount of time. Generally, $1\times10^5$ to about $1\times10^9$ cells/kg of body weight, from about $1\times10^6$ to about $1\times10^8$ cells/kg of body weight, or about $1\times10^7$ cells/kg of body weight, or more cells, as necessary, may be transplanted. In some embodiment, transplantation of at least about 100, 1000, 10,000, $0.1\times10^6$, $0.5\times10^6$, $1.0\times10^6$, $2.0\times10^6$, $3.0\times10^6$, $4.0\times10^6$, or $5.0\times10^6$ total cells relative to an average size mouse is effective.

Cancer vaccine can be administered in any suitable route as described herein, such as by infusion. Cancer vaccine can also be administered before, concurrently with, or after, other anti-cancer agents.

Administration can be accomplished using methods generally known in the art. Agents, including cells, may be introduced to the desired site by direct injection, or by any other means used in the art including, but are not limited to, intravascular, intracerebral, parenteral, intraperitoneal, intravenous, epidural, intraspinal, intrasternal, intra-articular, intra-synovial, intrathecal, intra-arterial, intracardiac, or intramuscular administration. For example, subjects of interest may be engrafted with the transplanted cells by various routes. Such routes include, but are not limited to, intravenous administration, subcutaneous administration, administration to a specific tissue (e.g., focal transplantation), injection into the femur bone marrow cavity, injection into the spleen, administration under the renal capsule of fetal liver, and the like. In certain embodiment, the cancer vaccine of the present invention is injected to the subject intratumorally or subcutaneously. Cells may be administered in one infusion, or through successive infusions over a defined time period sufficient to generate a desired effect. Exemplary methods for transplantation, engraftment assessment, and marker phenotyping analysis of transplanted cells are well-known in the art (see, for example, Pearson et al. (2008) *Curr. Protoc. Immunol.* 81:15.21.1-15.21.21; Ito et al. (2002) *Blood* 100:3175-3182; Traggiai et al. (2004) *Science* 304:104-107; Ishikawa et al. *Blood* (2005) 106:1565-1573; Shultz et al. (2005) *J. Immunol.* 174:6477-6489; and Holyoake et al. (1999) *Exp. Hematol.* 27:1418-1427).

Two or more cell types can be combined and administered, such as cancer vaccine and adoptive cell transfer of stem cells, cancer vaccine and other cell-based vaccines, and the like. For example adoptive cell-based immunotherapies can be combined with the cancer vaccine of the present invention. Well-known adoptive cell-based immunotherapeutic modalities, including, without limitation, irradiated autologous or allogeneic tumor cells, tumor lysates or apoptotic tumor cells, antigen-presenting cell-based immunotherapy, dendritic cell-based immunotherapy, adoptive T cell transfer, adoptive CAR T cell therapy, autologous immune enhancement therapy (AIET), cancer vaccines, and/or antigen presenting cells. Such cell-based immunotherapies can be further modified to express one or more gene products to further modulate immune responses, such as expressing cytokines like GM-CSF, and/or to express tumor-associated antigen (TAA) antigens, such as Mage-1, gp-100, and the like. The ratio of cancer cells in the cancer vaccine described herein to other cell types can be 1:1, but can modulated in any amount desired (e.g., 1:1, 1.1:1, 1.2:1, 1.3:1, 1.4:1, 1.5:1, 2:1, 2.5:1, 3:1, 3.5:1, 4:1, 4.5:1, 5:1, 5.5:1, 6:1, 6.5:1, 7:1, 7.5:1, 8:1, 8.5:1, 9:1, 9.5:1, 10:1, or greater).

Engraftment of transplanted cells may be assessed by any of various methods, such as, but not limited to, tumor volume, cytokine levels, time of administration, flow cytometric analysis of cells of interest obtained from the subject at one or more time points following transplantation, and the like. For example, a time-based analysis of waiting 1, 2, 3, 4, 5, 6, 7, 8, 9, 10, 11, 12, 13, 14, 15, 16, 17, 18, 19, 20, 21, 22, 23, 24, 25, 26, 27, 28 days or can signal the time for tumor harvesting. Any such metrics are variables that can be adjusted according to well-known parameters in order to determine the effect of the variable on a response to anti-cancer immunotherapy. In addition, the transplanted cells can be co-transplanted with other agents, such as cytokines, extracellular matrices, cell culture supports, and the like.

In addition, anti-cancer agents (e.g., TGFβ superfamily proteins, agents that increase the copy number, amount, and/or activity of at least one biomarker listed in Table 1, and/or immune checkpoint inhibitors) of the present invention can be administered to subjects or otherwise applied outside of a subject body in a biologically compatible form suitable for pharmaceutical administration. By "biologically compatible form suitable for administration in vivo" is meant a form to be administered in which any toxic effects are outweighed by the therapeutic effects. Administration of an anti-cancer agent as described herein can be in any pharmacological form including a therapeutically active amount of an agent alone or in combination with a pharmaceutically acceptable carrier. The phrase "therapeutically-effective amount" as used herein means that amount of an agent that is effective for producing some desired therapeutic effect, e.g., cancer treatment, at a reasonable benefit/risk ratio.

Administration of a therapeutically active amount of the therapeutic composition of the present invention is defined as an amount effective, at dosages and for periods of time necessary, to achieve the desired result. For example, a therapeutically active amount of an agent may vary according to factors such as the disease state, age, sex, and weight of the individual, and the ability of peptide to elicit a desired response in the individual. Dosage regimens can be adjusted to provide the optimum therapeutic response. For example, several divided doses can be administered daily or the dose can be proportionally reduced as indicated by the exigencies of the therapeutic situation.

A combination dosage form or simultaneous administration of single agents can result in effective amounts of each desired modulatory agent present in the patient at the same time.

The therapeutic agents described herein can be administered in a convenient manner such as by injection (subcutaneous, intravenous, etc.), oral administration, inhalation, transdermal application, or rectal administration. Depending on the route of administration, the active compound can be coated in a material to protect the compound from the action of enzymes, acids and other natural conditions which may inactivate the compound. For example, for administration of agents, by other than parenteral administration, it may be desirable to coat the agent with, or co-administer the agent with, a material to prevent its inactivation.

An agent can be administered to an individual in an appropriate carrier, diluent or adjuvant, co-administered with enzyme inhibitors or in an appropriate carrier such as liposomes. Pharmaceutically acceptable diluents include saline and aqueous buffer solutions. Adjuvant is used in its broadest sense and includes any immune stimulating compound such as interferon. Adjuvants contemplated herein include resorcinols, non-ionic surfactants such as polyoxyethylene oleyl ether and n-hexadecyl polyethylene ether. Enzyme inhibitors include pancreatic trypsin inhibitor, diisopropylfluorophosphate (DEEP) and trasylol. Liposomes include water-in-oil-in-water emulsions as well as conventional liposomes (Sterna et al. (1984) *J. Neuroimmunol.* 7:27).

The agent may also be administered parenterally or intraperitoneally. Dispersions can also be prepared in glycerol, liquid polyethylene glycols, and mixtures thereof, and in oils. Under ordinary conditions of storage and use, these preparations may contain a preservative to prevent the growth of microorganisms.

Pharmaceutical compositions of agents suitable for injectable use include sterile aqueous solutions (where water soluble) or dispersions and sterile powders for the extemporaneous preparation of sterile injectable solutions or dispersion. In all cases the composition will preferably be sterile and must be fluid to the extent that easy syringeability exists. It will preferably be stable under the conditions of manufacture and storage and preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it is preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating an agent of the invention in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the agent plus any additional desired ingredient from a previously sterile-filtered solution thereof.

When the agent is suitably protected, as described above, the protein can be orally administered, for example, with an inert diluent or an assimilable edible carrier. As used herein "pharmaceutically acceptable carrier" includes any and all solvents, dispersion media, coatings, antibacterial and antifungal agents, isotonic and absorption delaying agents, and the like. The use of such media and agents for pharmaceutically active substances is well-known in the art. Except insofar as any conventional media or agent is incompatible with the active compound, use thereof in the therapeutic compositions is contemplated. Supplementary active compounds can also be incorporated into the compositions.

It is especially advantageous to formulate parenteral compositions in dosage unit form for ease of administration and uniformity of dosage. "Dosage unit form", as used herein, refers to physically discrete units suited as unitary dosages for the mammalian subjects to be treated; each unit containing a predetermined quantity of active compound calculated to produce the desired therapeutic effect in association with the required pharmaceutical carrier. The specification for the dosage unit forms of the invention are dictated by, and directly dependent on, (a) the unique characteristics of the active compound and the particular therapeutic effect to be achieved, and (b) the limitations inherent in the art of compounding such an active compound for the treatment of sensitivity in individuals.

VII. Kits

The present invention also encompasses kits. For example, the kit can comprise PTEN and p53-deficient cancer cells modified as described herein, TGFβ superfamily proteins, agents that increase the copy number, amount, and/or activity of at least one biomarker listed in Table 1, immune checkpoint inhibitors, and combinations thereof, packaged in a suitable container and can further comprise instructions for using such reagents. The kit may also contain other components, such as administration tools packaged in a separate container.

Other embodiments of the present invention are described in the following Examples. The present invention is further illustrated by the following examples which should not be construed as further limiting. The contents of all references, patents and published patent applications cited throughout this application, as well as the Figures, are incorporated herein by reference.

EXAMPLES

Example 1: Materials and Methods for Examples 2-7 a. Cell Culture

PP and $PP_T$ breast cancer cells were cultured in DMEM/F12 (3:1) media supplemented with 10% fetal bovine serum (FBS), 25 ng/ml hydrocortisone, 5 μg/ml insulin, 8.5 ng/ml cholera toxin, 0.125 ng/ml epidermal growth factor (EGF), 5 μM Y-27632 Rock1 inhibitor, penicillin (100 U/mL), and streptomycin (100 mg/mL). For $PP_T$ cells, 4 ng/ml TGFβ1 was freshly added into the media every three days. Cells were incubated at 37° C. in a humidified atmosphere under 5% $CO_2$. NMuMG, HMEC, MCF10A, ZR-75-1, MDA-MB-453, MDA-MB-231, MCF7, BT549, HCC1954 and HCC70 cells were purchased from American Type Culture Collection (ATCC) and were cultured according to vendor's instructions.

b. Antibodies and Reagents

TGFβ1 (#GF111) was purchased from Millipore (Billerica, MA, USA). FITC anti-mouse CD45 (30-F11), PE/Dazzle™ 594 anti-mouse CD3 (145-2C11), APC/Cy7 anti-mouse CD4 (RM4-5), Alexa Fluor® 700 anti-mouse CD8 (53-6.7), APC anti-mouse TNFα (MP6-XT22), PE anti-mouse IFNγ (XMG1.2), PE/Cy7 anti-mouse CD11c (N418), APC/Cy7 anti-mouse I-A/I-E (M5/114.15.2), PerCP/Cy5 anti-mouse CD103 (2E7), PE anti-mouse CD80 (16-10A1), FITC anti-human CD45 (H130), Alexa Fluor® 700 anti-human CD11C (Bu15), PerCP/Cy5 anti-human CD80 (2D10), Pacific Blue™ anti-human CD86 (IT2.2), and anti-human APC CD103 (Ber-ACT8) were purchased from Biolegend (San Diego, CA, USA). Smad2 (D43B4) rabbit monoclonal antibody (#5339), phospho-Smad2 (Ser465/467; 138D4) rabbit monoclonal antibody, Lamin A/C (4C11) mouse monoclonal antibody, and p63 (D9L7L) rabbit monoclonal antibody (#39692) were purchased from Cell Signaling Technology. Anti-Vinculin antibody (#V9131) was bought from Sigma Aldrich.

c. Real-Time PCR

Real-time PCR was performed using SYBR® Select Master Mix on an Applied Biosystems® 7300 Fast Real-Time PCR system according to manufacturer's instructions. In brief, incubation cycles were as follows: 95° C. for 10 min, then 95° C. for 15 s, 60° C. for 1 min. Amplification was completed by 40 cycles and melting curves were measured. Primers used for real-time PCR assay are shown in Table. 3.

TABLE 3

| | |
|---|---|
| mAxl-F | ATGGCCGACATTGCCAGTG (SEQ ID NO: 191) |
| mAxl-R | CGGTAGTAATCCCCGTTGTAGA (SEQ ID NO: 192) |
| mBatf3-F | CAGAGCCCCAAGGACGATG (SEQ ID NO: 193) |
| mBatf3-R | GCACAAAGTTCATAGGACACAGC (SEQ ID NO: 194) |
| mCcl2-F | TTAAAAACCTGGATCGGAACCAA (SEQ ID NO: 195) |
| mCcl2-R | GCATTAGCTTCAGATTTACGGGT (SEQ ID NO: 196) |
| mCcl7-F | GCTGCTTTCAGCATCCAAGTG (SEQ ID NO: 197) |
| mCcl7-R | CCAGGGACACCGACTACTG (SEQ ID NO: 198) |
| mCcl8-F | CTGGGCCAGATAAGGCTCC (SEQ ID NO: 199) |
| mCCL8-F | CTGGGCCAGATAAGGCTCC (SEQ ID NO: 199) |
| mCcl8-R | CATGGGGCACTGGATATTGTT (SEQ ID NO: 200) |
| mCCL8-R | CATGGGGCACTGGATATTGTT (SEQ ID NO: 200) |
| mCCR7-F | TGTACGAGTCGGTGTGCTTC (SEQ ID NO: 201) |
| mCCR7-R | GGTAGGTATCCGTCATGGTCTTG (SEQ ID NO: 202) |
| mCD14-F | CTCTGTCCTTAAAGCGGCTTAC (SEQ ID NO: 203) |
| mCD14-R | GTTGCGGAGGTTCAAGATGTT (SEQ ID NO: 204) |
| mCD200-F | CTCTCCACCTACAGCCTGATT (SEQ ID NO: 205) |
| mCD200-R | AGAACATCGTAAGGATGCAGTTG (SEQ ID NO: 206) |
| mCD207-F | CCGAAGCGCACTTCACAGT (SEQ ID NO: 207) |
| mCD207-R | GCAGATACAGAGAGGTTTCCTCA (SEQ ID NO: 208) |
| mCD4-F | TCCTAGCTGTCACTCAAGGGA (SEQ ID NO: 209) |
| mCD4-R | TCAGAGAACTTCCAGGTGAAGA (SEQ ID NO: 210) |
| mCD40-F | TGTCATCTGTGAAAAGGTGGTC (SEQ ID NO: 211) |
| mCD40-R | ACTGGAGCAGCGGTGTTATG (SEQ ID NO: 212) |
| mCD45-F | CAGAAACGCCTAAGCCTAGTTG (SEQ ID NO: 213) |
| mCD45-R | ATGCAGGATCAGGTTTAGATGC (SEQ ID NO: 214) |
| mCD74-F | AGTGCGACGAGAACGGTAAC (SEQ ID NO: 215) |
| mCD74-R | CGTTGGGGAACACACACCA (SEQ ID NO: 216) |
| mCD8-F | CCGTTGACCCGCTTTCTGT (SEQ ID NO: 217) |
| mCD8-R | CGGCGTCCATTTTCTTTGGAA (SEQ ID NO: 218) |
| mCd80-F | ACCCCCAACATAACTGAGTCT (SEQ ID NO: 219) |
| mCd80-R | TTCCAACCAAGAGAAGCGAGG (SEQ ID NO: 220) |
| mCD86-F | CTGGACTCTACGACTTCACAATG (SEQ ID NO: 221) |
| mCD86-R | AGTTGGCGATCACTGACAGTT (SEQ ID NO: 222) |
| mCD8a-F | CCGTTGACCCGCTTTCTGT (SEQ ID NO: 217) |
| mCD8a-R | CGGCGTCCATTTTCTTTGGAA (SEQ ID NO: 218) |
| mCeacam1-F | TTCCCTGGGGAGGACTACTG (SEQ ID NO: 225) |
| mCeacam1-R | TGTATGCTTGCCCCGTGAAAT (SEQ ID NO: 226) |
| mClec9a-F | GAAGTGCCAATCCCCTAGCAA (SEQ ID NO: 227) |
| mClec9a-R | CAGTCACTACCTGAATGGAGAGA (SEQ ID NO: 228) |

TABLE 3-continued

| | |
|---|---|
| mCtsb-F | TCCTTGATCCTTCTTTCTTGCC (SEQ ID NO: 229) |
| mCtsb-F | TCCTTGATCCTTCTTTCTTGCC (SEQ ID NO: 229) |
| mCtsb-R | ACAGTGCCACACAGCTTCTTC (SEQ ID NO: 230) |
| mCtsb-R | ACAGTGCCACACAGCTTCTTC (SEQ ID NO: 230) |
| mCts1-F | ATCAAACCTTTAGTGCAGAGTGG (SEQ ID NO: 231) |
| mCts1-F | ATCAAACCTTTAGTGCAGAGTGG (SEQ ID NO: 231) |
| mCts1-R | CTGTATTCCCCGTTGTGTAGC (SEQ ID NO: 232) |
| mCts1-R | CTGTATTCCCCGTTGTGTAGC (SEQ ID NO: 232) |
| mCXCL10-F | CCAAGTGCTGCCGTCATTTTC (SEQ ID NO: 233) |
| mCXCL10-R | GGCTCGCAGGGATGATTTCAA (SEQ ID NO: 234) |
| mCXCR3-F | TACCTTGAGGTTAGTGAACGTCA (SEQ ID NO: 235) |
| mCXCR3-R | CGCTCTCGTTTTCCCCATAATC (SEQ ID NO: 236) |
| mFyn-F | ACCTCCATCCCGAACTACAAC (SEQ ID NO: 237) |
| mFyn-R | CGCCACAAACAGTGTCACTC (SEQ ID NO: 238) |
| mGas6-F | TGCTGGCTTCCGAGTCTTC (SEQ ID NO: 239) |
| mGas6-R | CGGGGTCGTTCTCGAACAC (SEQ ID NO: 240) |
| mH2-Ab1-F | AGCCCCATCACTGTGGAGT (SEQ ID NO: 241) |
| mH2-Ab1-R | GATGCCGCTCAACATCTTGC (SEQ ID NO: 242) |
| mH2-D1-F | CCCTGACCTGGCAGTTGAATG (SEQ ID NO: 243) |
| mH2-D1-R | AGCTCCAATGATGGCCATAGC (SEQ ID NO: 244) |
| mHspa1b-F | GAGATCGACTCTCTGTTCGAGG (SEQ ID NO: 245) |
| mHspa1b-R | GCCCGTTGAAGAAGTCCTG (SEQ ID NO: 246) |
| mIcos-F | ATGAAGCCGTACTTCTGCCAT (SEQ ID NO: 247) |
| mIcos-R | CGCATTTTTAACTGCTGGACAG (SEQ ID NO: 248) |
| mIfnb1-F | CAGCTCCAAGAAAGGACGAAC (SEQ ID NO: 249) |
| mIfnb1-R | GGCAGTGTAACTCTTCTGCAT (SEQ ID NO: 250) |
| mIfng-F | ATGAACGCTACACACTGCATC (SEQ ID NO: 251) |
| mIfng-R | CCATCCTTTTGCCAGTTCCTC (SEQ ID NO: 252) |
| mIL12b-F | TGGTTTGCCATCGTTTTGCTG (SEQ ID NO: 253) |
| mIL12b-R | ACAGGTGAGGTTCACTGTTTCT (SEQ ID NO: 254) |
| mIL18-F | GTGAACCCCAGACCAGACTG (SEQ ID NO: 255) |
| mIL18-R | CCTGGAACACGTTTCTGAAAGA (SEQ ID NO: 256) |
| mIL1b-F | GAAATGCCACCTTTTGACAGTG (SEQ ID NO: 257) |
| mIL1b-R | TGGATGCTCTCATCAGGACAG (SEQ ID NO: 258) |
| mIL2ra-F | AACCATAGTACCCAGTTGTCGG (SEQ ID NO: 259) |
| mIL2ra-R | TCCTAAGCAACGCATATAGACCA (SEQ ID NO: 260) |
| mIL2rb-F | TGGAGCCTGTCCCTCTACG (SEQ ID NO: 261) |
| mIL2rb-R | TCCACATGCAAGAGACATTGG (SEQ ID NO: 262) |
| mIL6st-F | CCGTGTGGTTACATCTACCCT (SEQ ID NO: 263) |
| mIL6st-R | CGTGGTTCTGTTGATGACAGTG (SEQ ID NO: 264) |

TABLE 3-continued

| | |
|---|---|
| mIrf1-F | ATGCCAATCACTCGAATGCG (SEQ ID NO: 265) |
| mIrf1-R | TTGTATCGGCCTGTGTGAATG (SEQ ID NO: 266) |
| mIrf4-F | TCCGACAGTGGTTGATCGAC (SEQ ID NO: 267) |
| mIrf4-R | CCTCACGATTGTAGTCCTGCTT (SEQ ID NO: 268) |
| mIrf8-F | CGGGGCTGATCTGGGAAAAT (SEQ ID NO: 269) |
| mIrf8-R | CACAGCGTAACCTCGTCTTC (SEQ ID NO: 270) |
| mItga6-F | TGCAGAGGGCGAACAGAAC (SEQ ID NO: 271) |
| mItga6-R | GCACACGTCACCACTTTGC (SEQ ID NO: 272) |
| mItgae-F | CCTGTGCAGCATGTAAAAGAATG (SEQ ID NO: 273) |
| mItgae-R | CAAGGATCGGCAGTTCAGATAC (SEQ ID NO: 274) |
| mItgam-F | ATGGACGCTGATGGCAATACC (SEQ ID NO: 275) |
| mItgam-R | TCCCCATTCACGTCTCCCA (SEQ ID NO: 276) |
| mKlrc1-F | GCCCCTGCAAAGATACCGAA (SEQ ID NO: 277) |
| mKlrc1-R | TCTGTGGGTTCTAGTCATTGAGG (SEQ ID NO: 278) |
| mLamp1-F | CAGCACTCTTTGAGGTGAAAAAC (SEQ ID NO: 279) |
| mLamp1-R | ACGATCTGAGAACCATTCGCA (SEQ ID NO: 280) |
| mLifr-F | TACGTCGGCAGACTCGATATT (SEQ ID NO: 281) |
| mLifr-R | TGGGCGTATCTCTCTCTCCTT (SEQ ID NO: 282) |
| mMalt1-F | CACAGAACTGAGCGACTTCCT (SEQ ID NO: 283) |
| mMalt1-R | CAGCCAACACTGCCTTGGA (SEQ ID NO: 284) |
| mNotch2-F | GAGAAAAACCGCTGTCAGAATGG (SEQ ID NO: 285) |
| mNotch2-R | GGTGGAGTATTGGCAGTCCTC (SEQ ID NO: 286) |
| mPik3cd-F | GTAAACGACTTCCGCACTAAGA (SEQ ID NO: 287) |
| mPik3cd-R | GCTGACACGCAATAAGCCG (SEQ ID NO: 288) |
| mRelb-F | CCGTACCTGGTCATCACAGAG (SEQ ID NO: 289) |
| mRelb-R | CAGTCTCGAAGCTCGATGGC (SEQ ID NO: 290) |
| mSirpa-F | CCACGGGGAAGGAACTGAAG (SEQ ID NO: 291) |
| mSirpa-R | ACGTATTCTCCTGCGAAACTGTA (SEQ ID NO: 292) |
| mTap1-F | GGACTTGCCTTGTTCCGAGAG (SEQ ID NO: 293) |
| mTAp1-R | GCTGCCACATAACTGATAGCGA (SEQ ID NO: 294) |
| mTapbp-F | ACAAGGCCCCCAGAGTGT (SEQ ID NO: 295) |
| mTapbp-R | GGAAGAAGTGGGATGCAAGA (SEQ ID NO: 296) |
| mTlr1-F | TGAGGGTCCTGATAATGTCCTAC (SEQ ID NO: 297) |
| mTlr1-R | AGAGGTCCAAATGCTTGAGGC (SEQ ID NO: 298) |
| mTlr3-F | GTGAGATACAACGTAGCTGACTG (SEQ ID NO: 299) |
| mTlr3-R | TCCTGCATCCAAGATAGCAAGT (SEQ ID NO: 300) |
| mTlr6-F | TGAGCCAAGACAGAAAACCCA (SEQ ID NO: 301) |
| mTlr6-R | GGGACATGAGTAAGGTTCCTGTT (SEQ ID NO: 302) |
| mTnf-F | CCCTCACACTCAGATCATCTTCT (SEQ ID NO: 303) |
| mTnf-R | GCTACGACGTGGGCTACAG (SEQ ID NO: 304) |
| mTnfaip3-F | GAACAGCGATCAGGCCAGG (SEQ ID NO: 305) |
| mTnfaip3-R | GGACAGTTGGGTGTCTCACATT (SEQ ID NO: 306) |
| mXcr1-F | CTCAGCCTTGTGGGTAACAGC (SEQ ID NO: 307) |
| mXcr1-R | ACAGGCAGTAGACAGGAGAAC (SEQ ID NO: 308) |
| mZeb2-F | ATTGCACATCAGACTTTGAGGAA (SEQ ID NO: 309) |
| mZeb2-R | ATAATGGCCGTGTCGCTTCG (SEQ ID NO: 310) |

d. Flow Cytometry Analysis

To obtain single cell suspensions, tumors were first disrupted by mechanical dissociation and then digested in dissociation buffer (1× collagenase/hyaluronidase [#07912, Stem Cell Technologies] in DMEM, 10 mM HEPES, 5% FBS, 100 ng/mL DNase I [#07900, Stem Cell Technologies], and penicillin-streptomycin [#14140122, Thermo Fisher]) for 1 hour at 37° C. Spleens and lymph nodes were first dissociated by passing through 70- and 40-μm cell strainers. Blood was collected by retro-orbital bleeding with EDTA microcaps (#47729-742, VWR) and microtainer (#0266933, Thermo Fisher), and blood cells were separated by centrifugation. For all tissues, red blood cells were lysed with ammonium chloride (4 volumes of 0.8% $NH_4Cl$ 0.1 mM EDTA [#07850, Stem Cell Technologies] plus 1 volume PBS). Single cell suspensions were then blocked with anti-CD16/32 (93, Biolegend) and stained with appropriate cell surface antibodies. For intracellular staining, cells were fixed and permeabilized using fixation and permeabilization wash buffers (#421002 and #4208801, Biolegend) according to manufacturer's instructions. Gating strategies can be found in the Supplementary Methods section.

e. Animal Experiments

Six-to-eight-week-old female nude, SCID and wild type FVB mice were purchased from Taconic Biosciences. For PP and $PP_T$ cell tumor formation assays, $1\times10^6$ cells were injected into the third fat pads in 50% matrigel. For tumor transplantation assays, $1\times10^5$ collagenase-digested PP tumor cells were injected into the third fat pads in 10% matrigel. For vaccination assays, $1\times10^6 PP_T$ cells were injected subcutaneously in 10% matrigel. After one month, PP cells or tumors were injected into the third fat pads of immunized mice. For in vivo depletion assays, mice were injected intravenously with Ultra-LEAF™ purified anti-CD3 (200 μg/mouse, 145-2C11, Biolegend), anti-CD4 (200 μg/mouse, GK1.5, Biolegend), anti-CD8 (200 μg/mouse, 53-6.7, Biolegend), or anti-IgG (200 μg/mouse, HTK888, Biolegend) one week before tumor challenge and weekly thereafter. All mouse experiments were performed in accordance with federal laws for animal protection and permission from the local veterinary office, and in compliance with the guidelines approved by the Institutional Animal Care and Use Committee of Dana-Farber Cancer Institute and Harvard Medical School.

f. Mouse Transcriptome Methodology and Analysis

An Ion AmpliSeq™ Custom Panel containing 4,604 cancer- and immune-associated genes (designed by Thermo Fisher using Ion AmpliSeq® Designer) was used for the studies as described previously (Goel et al. (2017) *Nature* 548:471-475). 10 ng total RNA was used to prepare the cDNA library for each sample. Libraries were multiplexed and amplified using an Ion OneTouch™ 2 System, and sequenced on an Ion Torrent Proton™ system (Thermo Fisher). Count data was generated by Thermo Fisher's Torrent Suite™ and AmpliSeq™ RNA analysis plugin. For gene ontology enrichment and KEGG pathway analysis, genes with a mean fold change ($PP_T$ vs PP) greater than two or lesser than 0.4 were utilized. Gene Ontology enrichment and KEGG pathway analysis were carried out using Cytoscape Software and STRING plugin.

g. In Vitro Immature DC Differentiation and Activation

Mouse bone marrow monocytes were isolated with EasySep™ Mouse Monocyte Isolation Kit (#19861, StemCell Technologies) from wild type female FVB mice according to vendor's instructions. Enriched monocytes were cultured in RPMI 1640 medium with 20 ng/ml mouse recombinant GM-CSF (Stem Cell Technologies, #78017), 10 ng/ml mouse recombinant IL-4 (Stem Cell Technologies, #78047), and 10% FBS for one week. Immature DCs were then incubated with indicated cells at a 1:1 ratio for 24 hours. Human bone marrow was purchased from ALLCELLS (#ABM001, MA). Monocytes were isolated with EasySep™ Human Monocyte Isolation Kit (#19359, StemCell) according to vendor's instruction. Monocytes were then cultured in RPMI 1640 medium with 10% FBS, 20 ng/ml human recombinant GM-CSF (#78190, Stem Cell) and 10 ng/ml human recombinant IL-4 (#78045, StemCell) for one week. DC function was determined by flow cytometry 24 hours after incubation with human breast cancer cell lines at a 1:1 ratio.

h. Mixed Lymphocyte Reaction Assay

Spleens collected from wild type female FVB mice were mechanically dissociated by passing through 70 μm cell strainers. Naïve CD3+ T cells were then isolated with EasySep™ Mouse Pan-Naïve T Cell Isolation Kit (Stem Cell Technologies, #19848) according to manufacturer's instructions. Purified T cells were co-cultured with tumor cells at a 10:1 ratio in presence or absence of immature DCs. After co-culturing overnight, cells were harvested and T cell activation was determined by flow cytometry.

i. Nuclear and Cytoplasmic Protein Extraction, Co-Immunoprecipitation, and Western Blotting Cells were lysed with cytoplasmic extract (CE) buffer (10 mM HEPES (pH 7.6), 50 mM KCl, 0.05% NP40, and phosphatase and protease inhibitors in 1×PBS) for 5 minutes on ice. Cell lysates were centrifuged at 2,300 g for 5 min and supernatants were collected as the cytoplasmic fraction. After three washes with CE buffer, the precipitate was lysed by sonication in nuclear extraction buffer (20 mM HEPES pH 7.6, 100 mM KCl, 5% glycerol, 0.5% NP40, phosphatase and protease inhibitors in 1×PBS). Cell lysates were centrifuged at 13,400 g for 5 min and supernatants were collected as the nuclear fraction. For co-immunoprecipitation assays, cell extracts were adjusted to 20 mM HEPES (pH 7.6), 0.1% NP40, 50 mM KCl, 5% glycerol and 2.5 mM $MgCl_2$, and incubated with an appropriate primary antibody or IgG overnight at 4° C. Protein A/G magnetic beads were added into the mixture and incubated for 2 hours. After three washes with binding buffer, beads were re-suspended in 1× western blotting loading buffer and denatured at 95° C. for 10 min. Western blot analysis was performed as previously described (Tang et al. (2015) *Nat. Commun.* 6:8230).

j. Statistical Analysis

Quantitative data were expressed as means±SEM. Statistical significance was determined by t-test for comparison of two groups and ANOVA with post-hoc analysis for three or more groups. A P-value of <0.05 was considered statistically significant.

Example 2: TGFβ-Treated Tumor Cells Induce T Cell Dependent Antitumor Immunity

Figure 16:
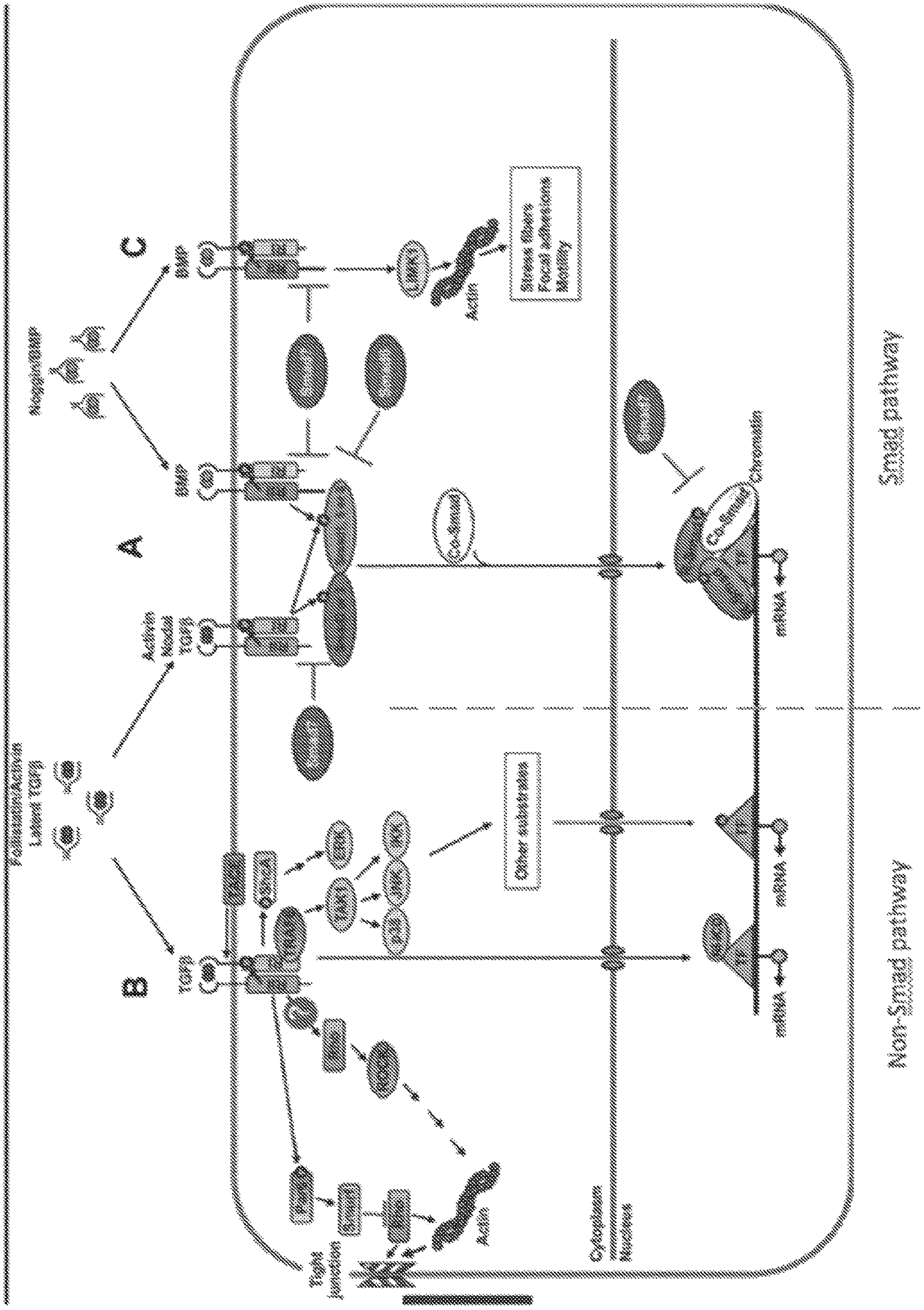
FIG. 16 shows a schematic diagram of TGFβ-Smad signaling pathway and molecular events adapted from Zhang et al. (2013) *J. Cell Sci.* 126:4809-4813.

Transforming growth factor beta (TGFβ) is a pluripotent cytokine that plays critical roles in regulating embryo development, cell metabolism, tumor progression, and immune system homeostasis (David and Massague (2018) *Nat. Rev. Mol. Cell. Biol.* 19:419-435). Upon binding to its receptors on plasma membrane, TGFβ, regulates the expressions of its downstream genes in Smad-dependent and independent manners (FIG. 16).

Figure 1A:
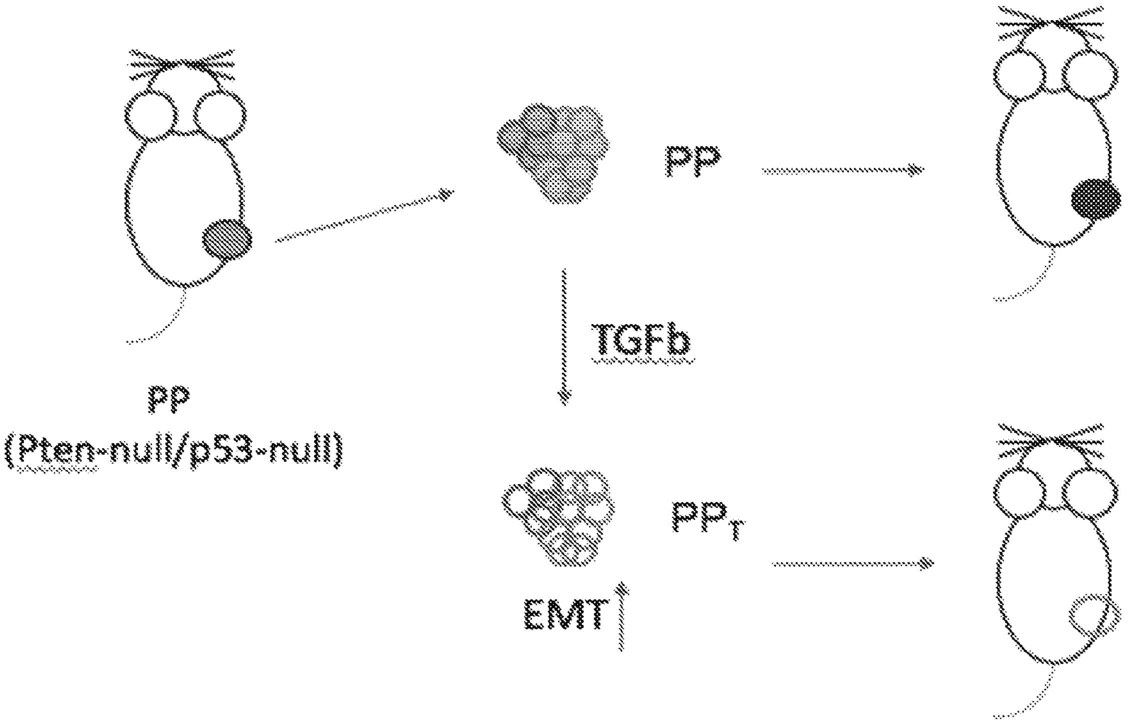
FIG. 1A-FIG. 1C show that TGFβ-treated PP ($PP_T$) tumor cells do not form tumors in immune competent mice.
Figure 1B:
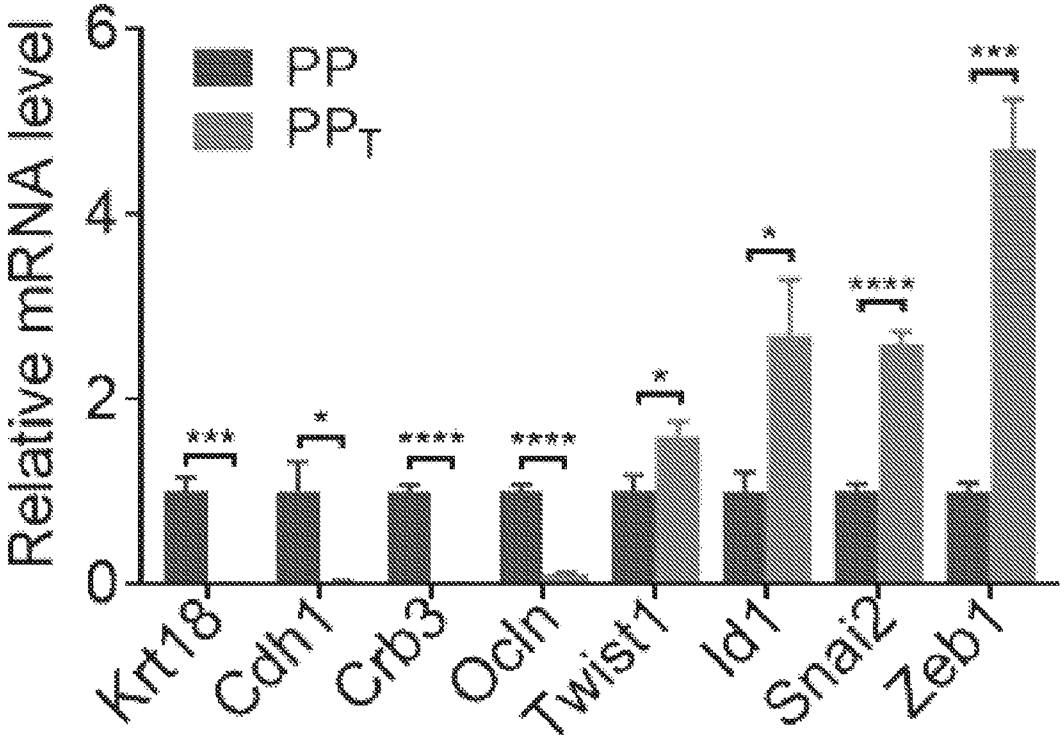
Figure 1C:
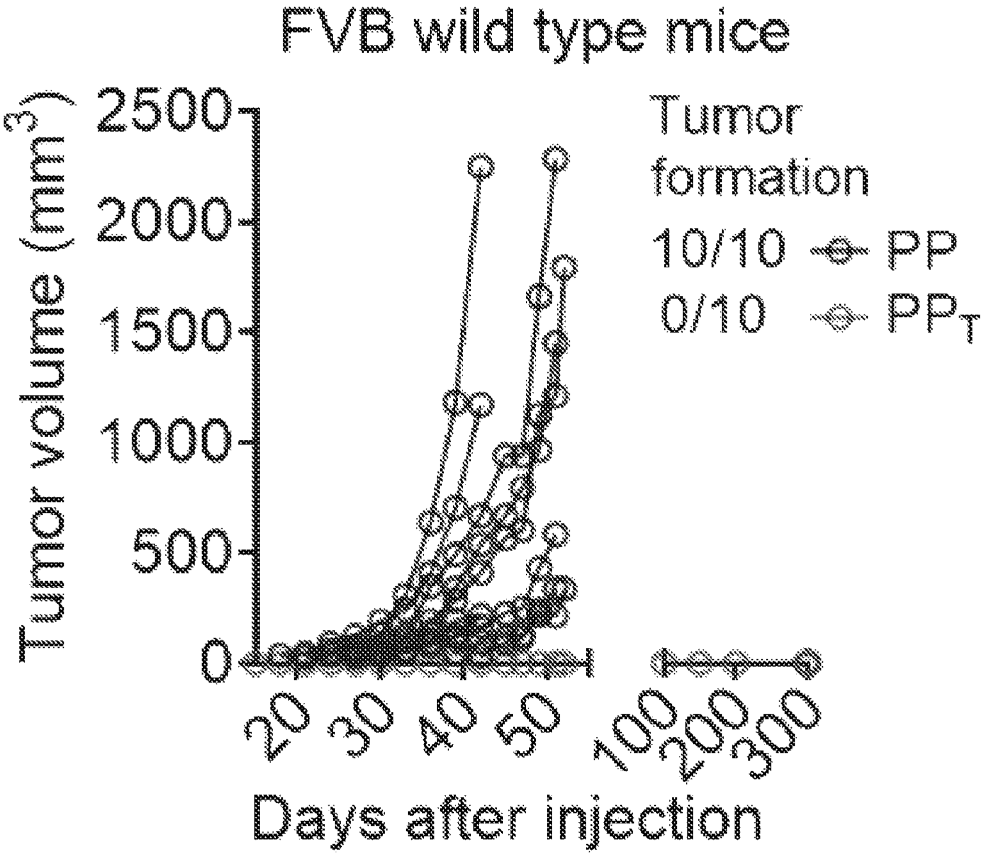
Figure 2A:
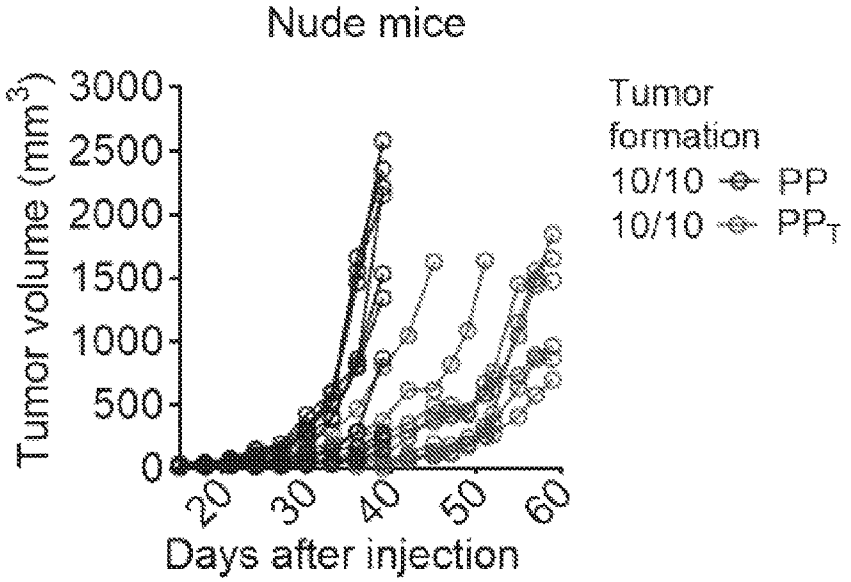
FIG. 2A-FIG. 2B show that $PP_T$ tumor cells formed tumors in immune-compromised mice with a longer latency. The growth rates of PP and $PP_T$ tumors in nude (FIG. 2A) and SCID (FIG. 2B) mice; n=10 per group.
Figure 2B:
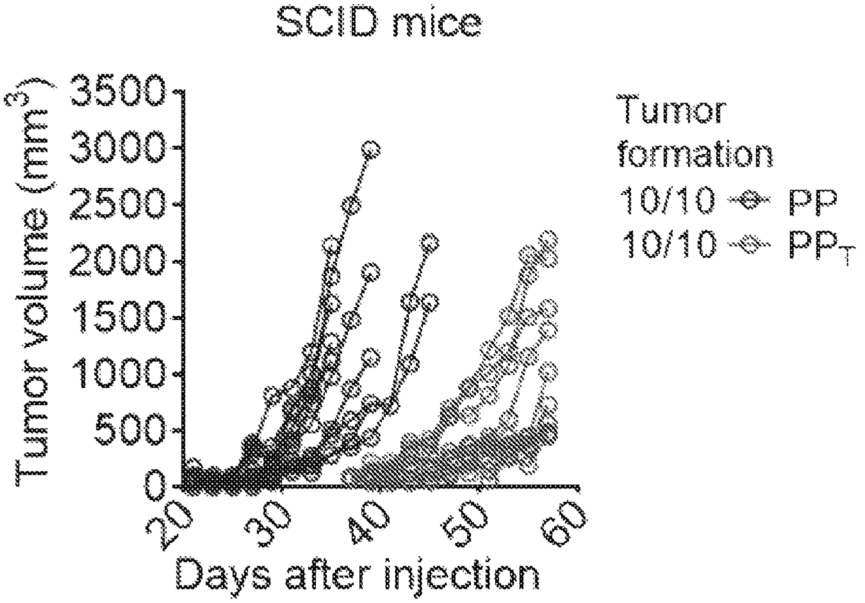

Loss of tumor suppressor p53 or PTEN is among the most frequent events in human cancer (Lawrence et al. (2014) *Nature* 505:495-501). The majority of advanced epithelial tumors, including triple-negative breast cancer (TNBC), exhibit loss of both p53 and PTEN (Cancer Genome Atlas Network (2012) *Nature* 490:61-70). A syngeneic genetically-engineered mouse model (GEMM) of TNBC derived from concurrent ablation of p53 (encoded by Trp53 in mice) and Pten (termed PP) in female FVB mice carrying K14-Cre; $Trp53^{L/L}$; $Pten^{L/L}$, was generated (Berrueta et al. (2018) *Sci. Rep.* 8:7864). To investigate the interaction of tumor cells harboring activated TGFβ signaling with the immune system, primary PP tumor cells were treated with TGFβ in vitro for a prolonged time (e.g., one month), and were subsequently allografted to FVB female mice. These TGFβ-treated PP cells (termed $PP_T$) were confirmed to have activated TGFβ signaling with significant induction of epithelial-to-mesenchymal transition (EMT; FIG. 1B). Unexpectedly, while orthotopic injection of PP cells into wild type FVB mice resulted in tumor formation with full penetration, $PP_T$ cells completely failed to form tumors in FVB recipients despite their EMT phenotype, which is usually associated with more aggressive tumors (FIG. 1C). However, both PP and $PP_T$ cells were able to grow in immune-compromised mouse hosts lacking adaptive immunity, including athymic nude and severe combined immunodeficient (SCID) mice, although the growth rate of $PP_T$ tumors was slower than that of PP tumors (FIGS. 2A and 2B).

Figure 3A:
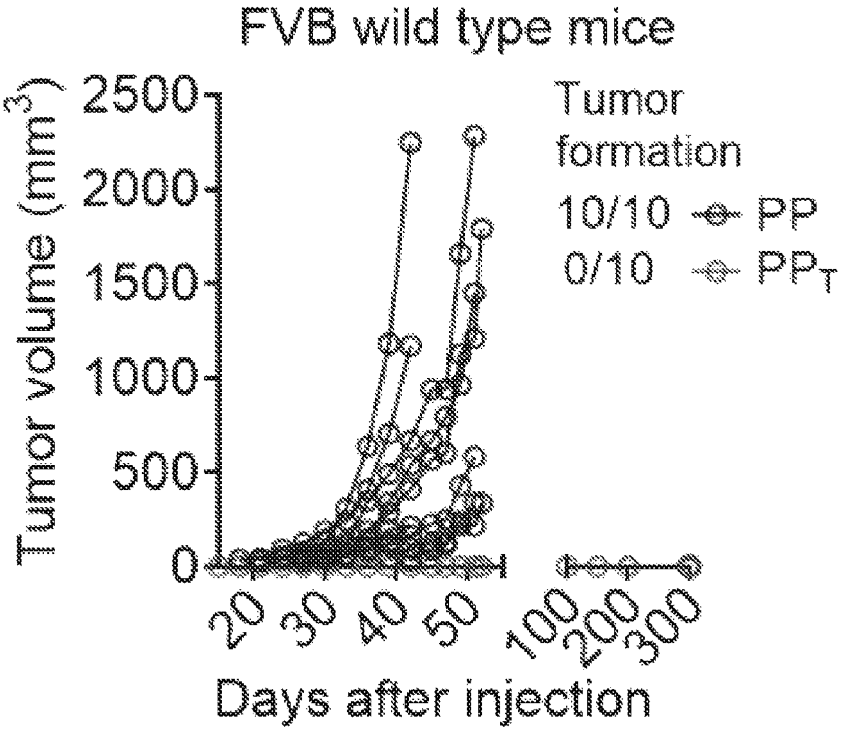
FIG. 3A-FIG. 3I show that $PP_T$ tumor cells-induced antitumor immunity was T cell-dependent.
Figure 3B:
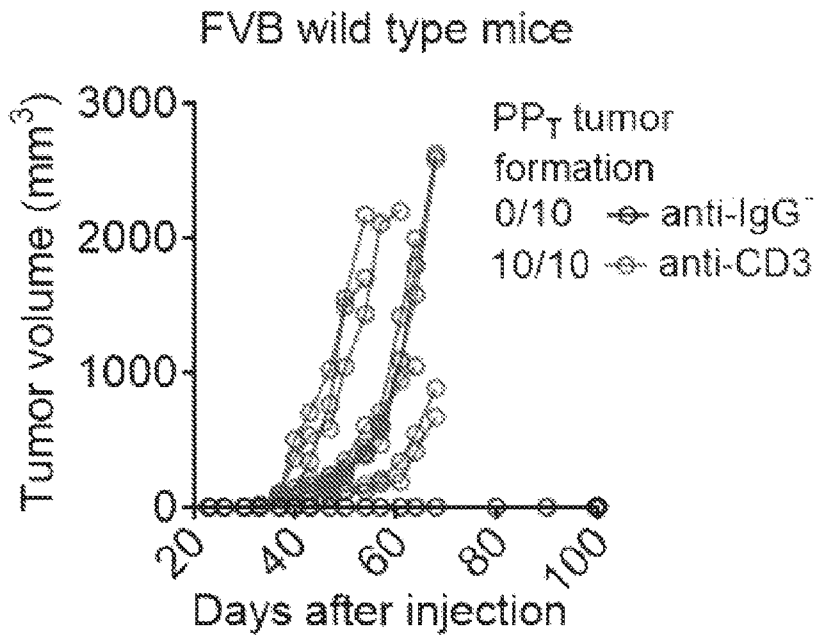
Figure 3C:
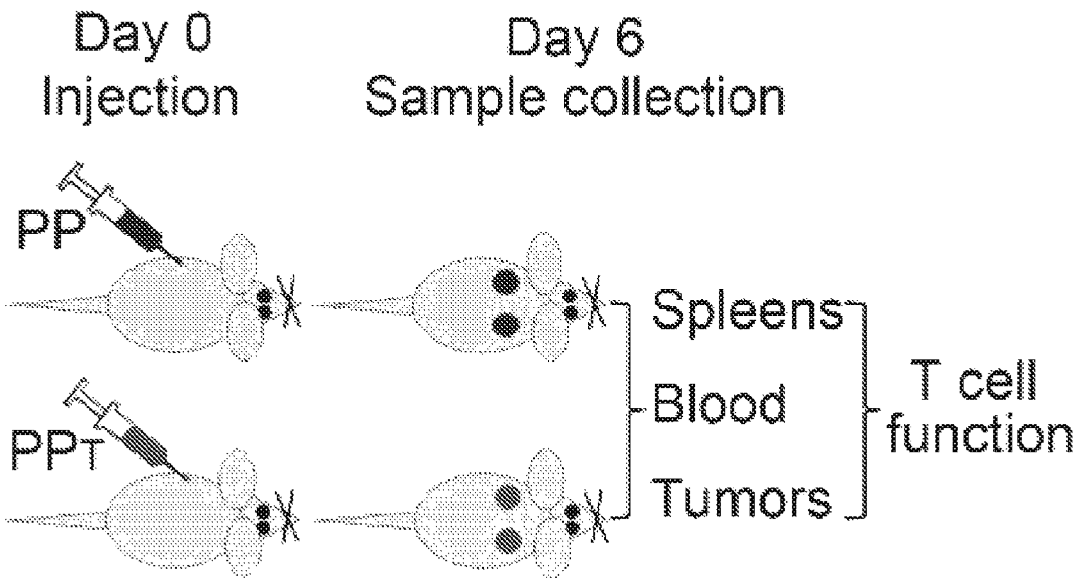
Figure 3D:
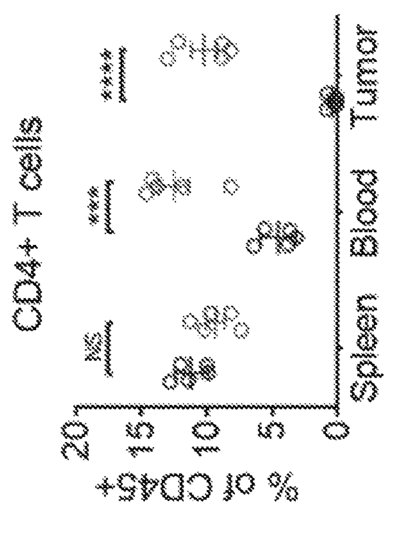
Figure 3E:
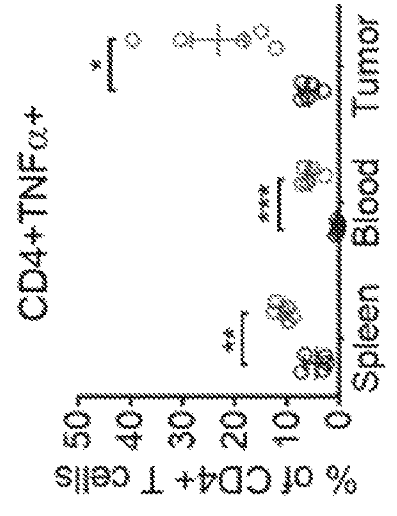
Figure 3F:
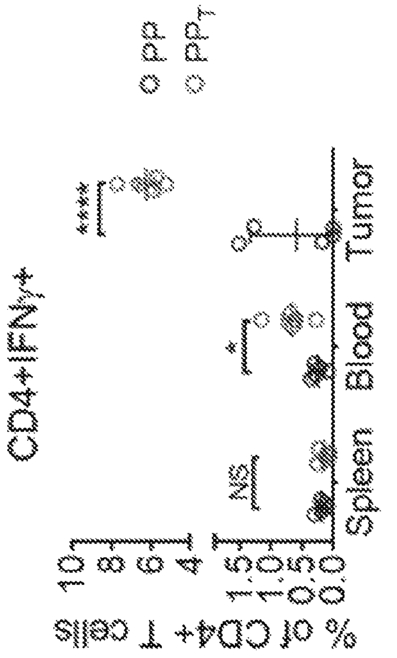
Figure 3G:
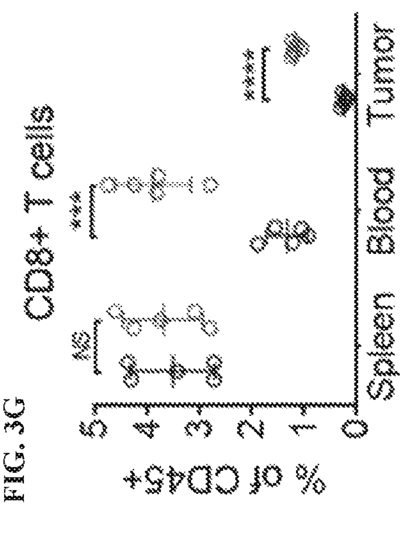
Figure 3H:
Figure 3I:
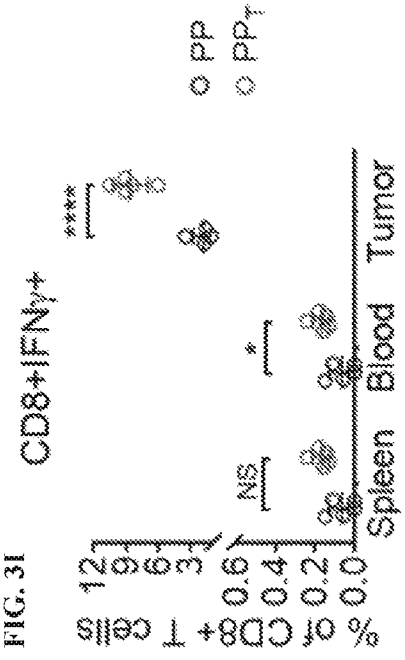

To further assess whether T cells are required for immune rejection of $PP_T$ cells, CD3+ T cells were depleted via injection of an antibody against CD3 in recipient FVB mice transplanted with $PP_T$ cells. In this case, in contrast to absolute no growth of $PP_T$ cells in FVB mice with proficient T cells, $PP_T$ cells were able to form tumors with 100% penetrance upon depletion of T cells (FIGS. 3A and 3B). Tumor tissue, spleens and blood were harvested from host mice six days after transplantation of PP or $PP_T$ tumor cells, and T cells were analyzed by flow cytometry (FIG. 3C). Both the abundance of CD4+ and CD8+ T cell levels, as well as TNFα and INFγ production, were significantly increased in the tumors and blood of $PP_T$-transplanted mice compared to PP-bearing mice (FIGS. 3D-3I). Together, these results indicate that activated TGFβ signaling in tumor cells triggers cytotoxic T cell-mediated antitumor immunity.

Figure 4A:
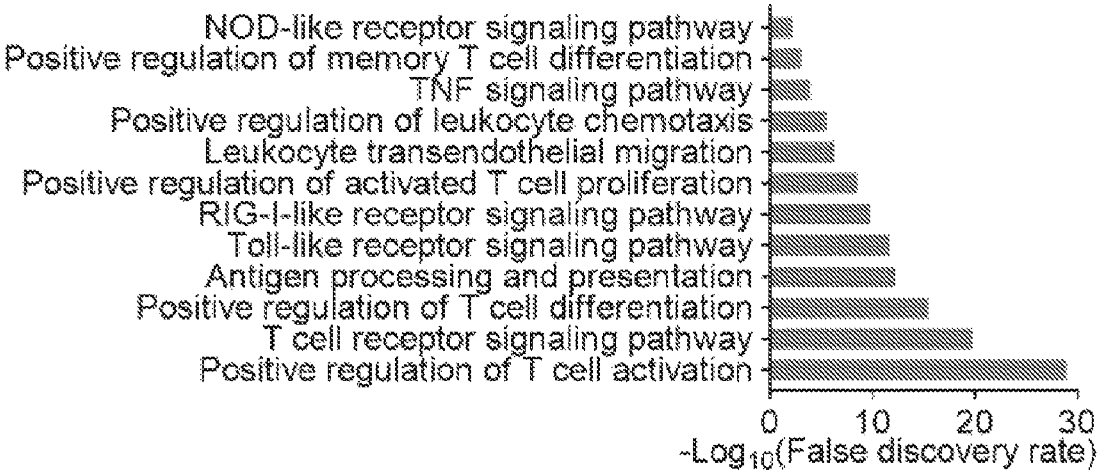
FIG. 4A-FIG. 4I show that antitumor immunity induced by activated TGFβ in tumor cells was provoked via enhanced activation of DC and T cells. A customized mouse transcriptome profiling was performed to compare gene expression profiles between PP and $PP_T$ 6-day-old tumor tissues (FIGS. 4A-4C). Gene ontology (GO) enrichment and KEGG pathway analyses were performed on up-regulated genes ($rpm_{PPT}$ vs $rpm_{pp}$>2-fold).
Figure 4B:
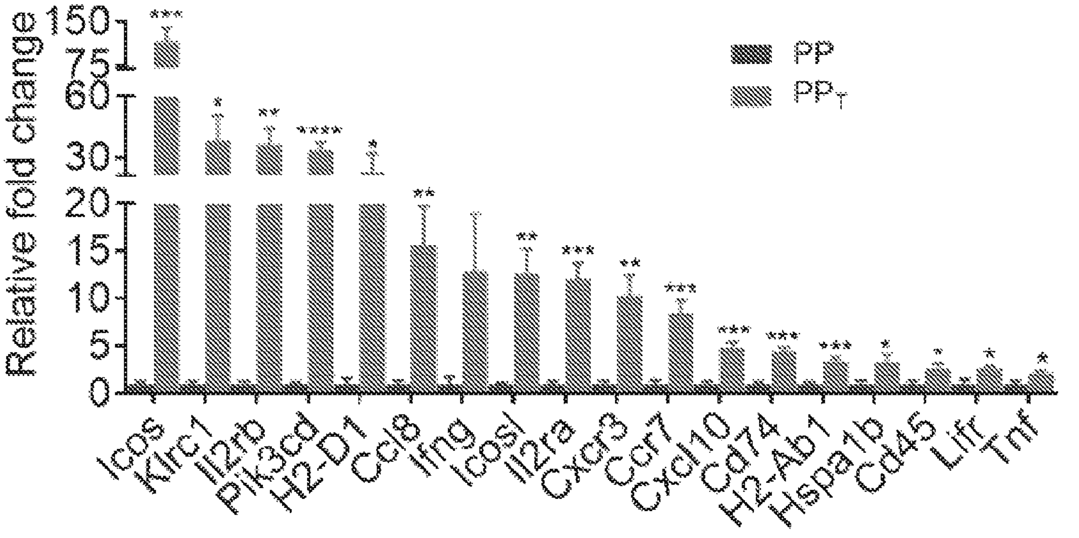

Example 3: DC Plays an Essential Role in Mediating TGFβ-Induced Antitumor Immunity In parallel, transcriptome analysis was performed across a panel of 4,604 cancer- and immune-related genes on PP and $PP_T$ tumor tissue isolated from recipient mice six days after engrafting. Notably, expression of genes with gene ontology (GO) terms related to activation of multiple immune pathways was greatly up-regulated in $PP_T$ tumors compared to PP tumors (FIG. 4A). Significant up-regulation of genes encoding cytokines, cytokine receptors, and T cell costimulatory molecules was further confirmed by real time quantitative PCR (FIG. 4B). Moreover, expression of genes encoding components of both class I and class II major histocompatibility complex (MHC), such as H2-D1, H2-Ab1 and Cd74, was significantly up-regulated in $PP_T$ tumor sites compared to PP tumors (FIG. 4B). These data further confirm that $PP_T$ cells were able to elicit a robust immune response in the tumor microenvironment.

Figure 4C:
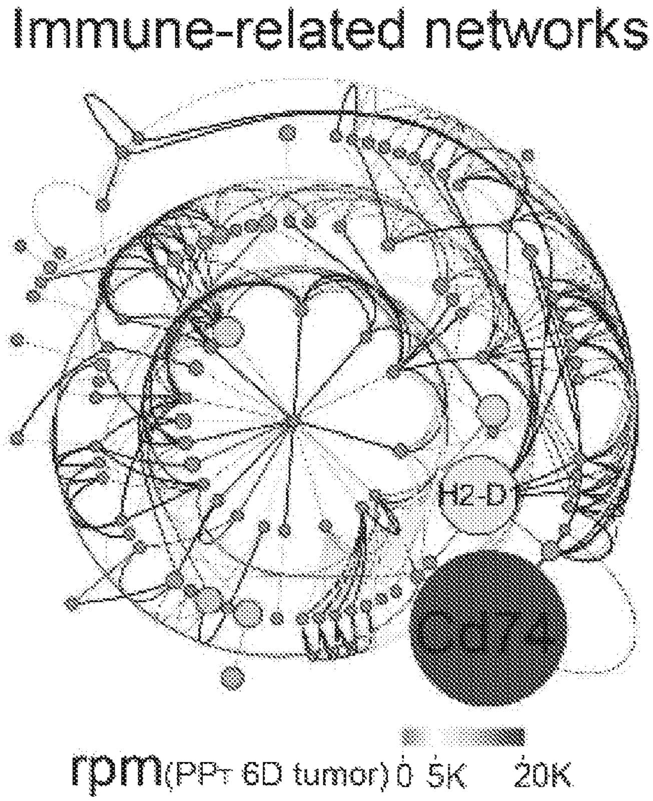
Figure 4D:
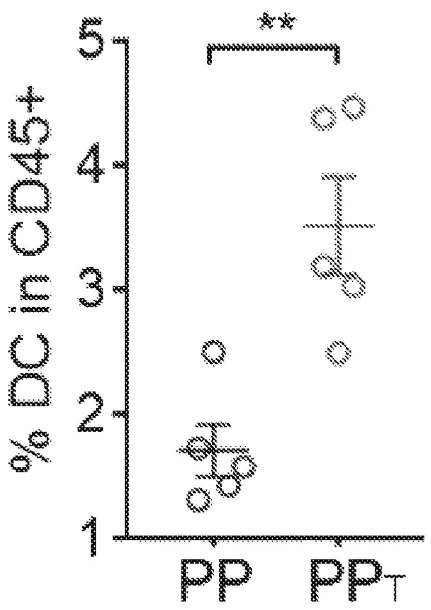
Figure 4E:
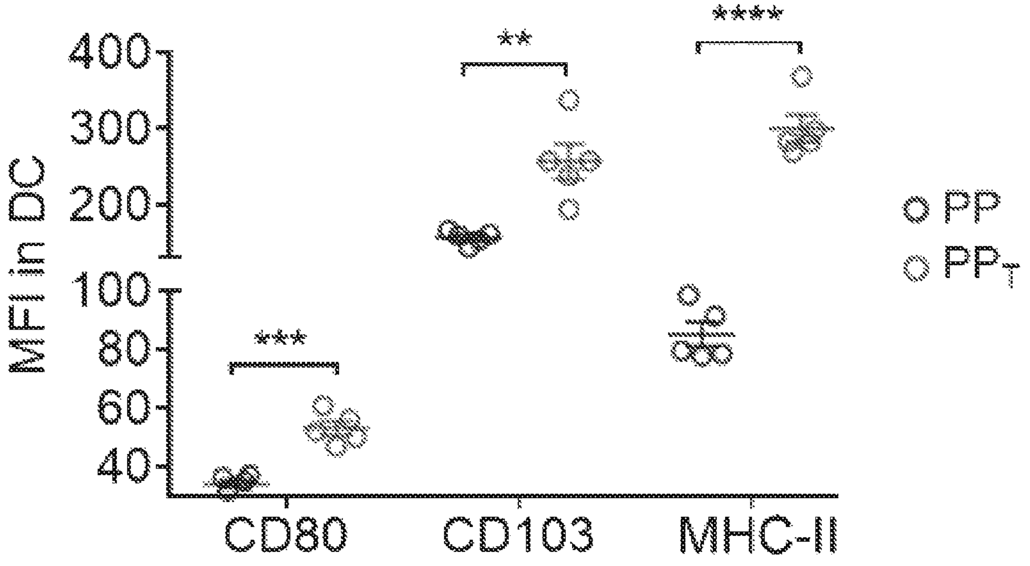
Figure 5A:
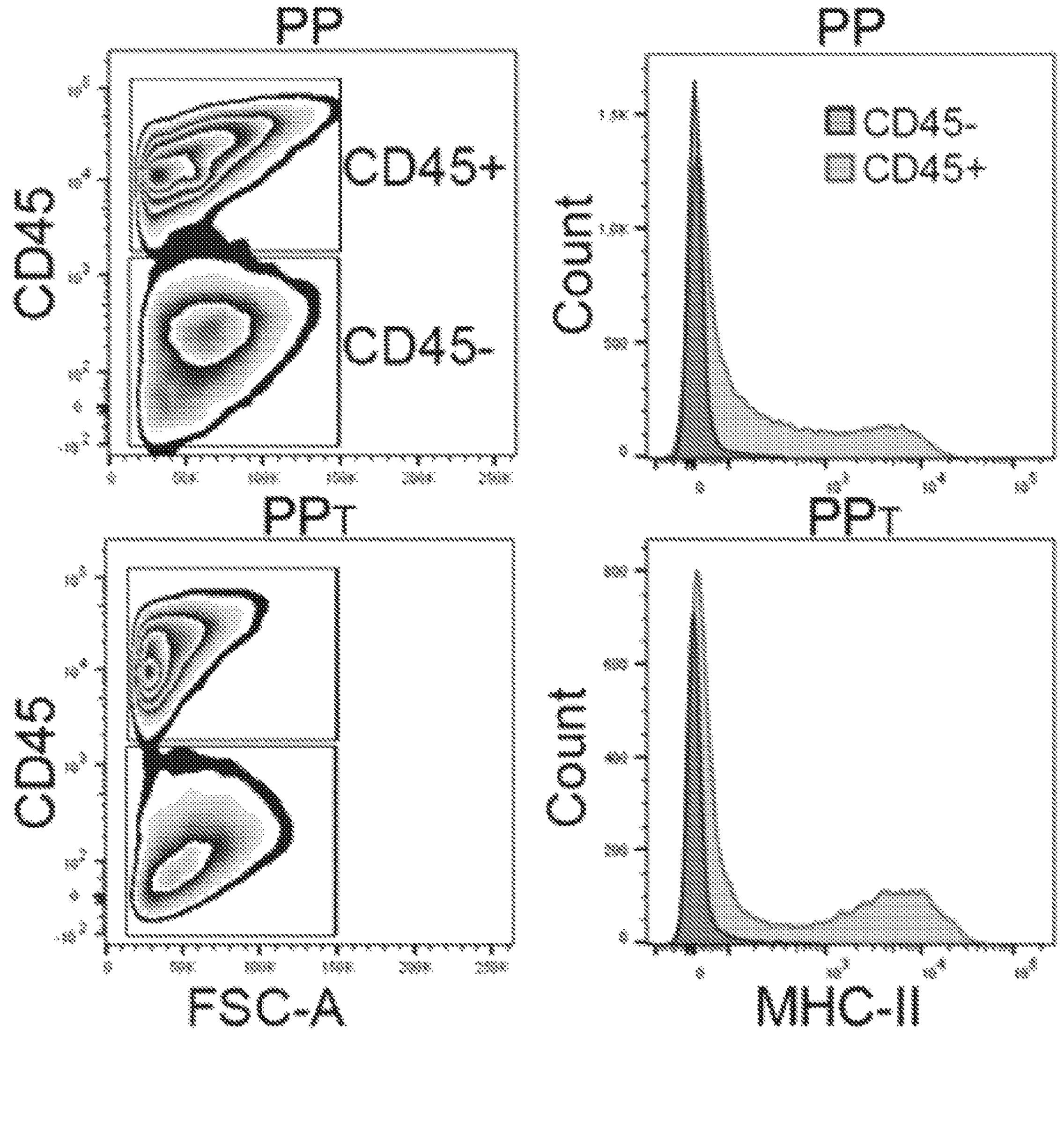
FIG. 5A-FIG. 5D show that dendritic cells were required for activation of T cells by $PP_T$ tumor cells.
Figure 5B:
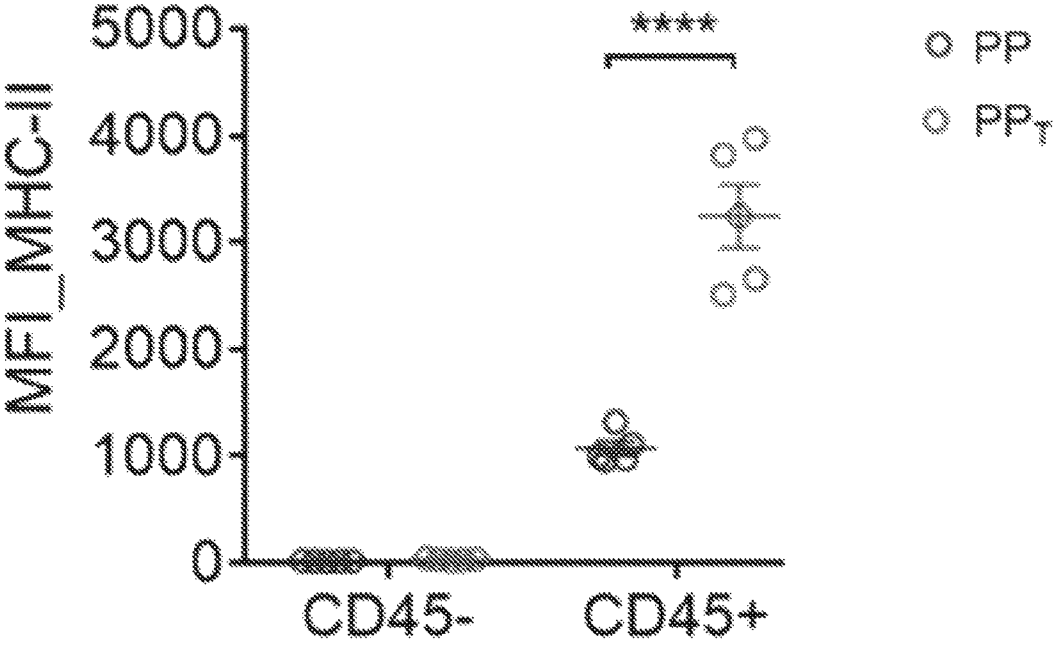

Interestingly, Cd74 (also known as HLA class II histocompatibility antigen gamma chain) was at the top of up-regulated immune-related networks in $PP_T$ tumor tissues (FIG. 4C). Flow cytometry analysis determined that neither PP nor $PP_T$ tumor cells express MHC class II molecules (FIGS. 5A and 5B), indicating that antigen-presenting cells (APCs), and dendritic cells (DCs) in particular, are likely involved in $PP_T$ tumor-induced immune response in the host animals. Indeed, $PP_T$ tumors had a significantly higher number of tumor-infiltrating DCs than PP tumors (FIG. 4D). Further analysis revealed that $PP_T$ tumor-associated DCs also have increased levels of CD80, a costimulatory molecule necessary for T cell activation, CD103, a critical molecule for priming tumor-specific CD8+ T cells and trafficking of effector T cells, and MHC-II antigen-presenting machinery (Eisenbarth (2019) *Nat. Rev. Immunol.* 19:89-103; Worbs et al. (2017) *Nat. Rev. Immunol.* 17:30-48) (FIG. 4E). These observations indicate that tumor-associated DCs play an important role in mediating antitumor immunity against TGFβ-treated tumor cells.

Figure 4F:
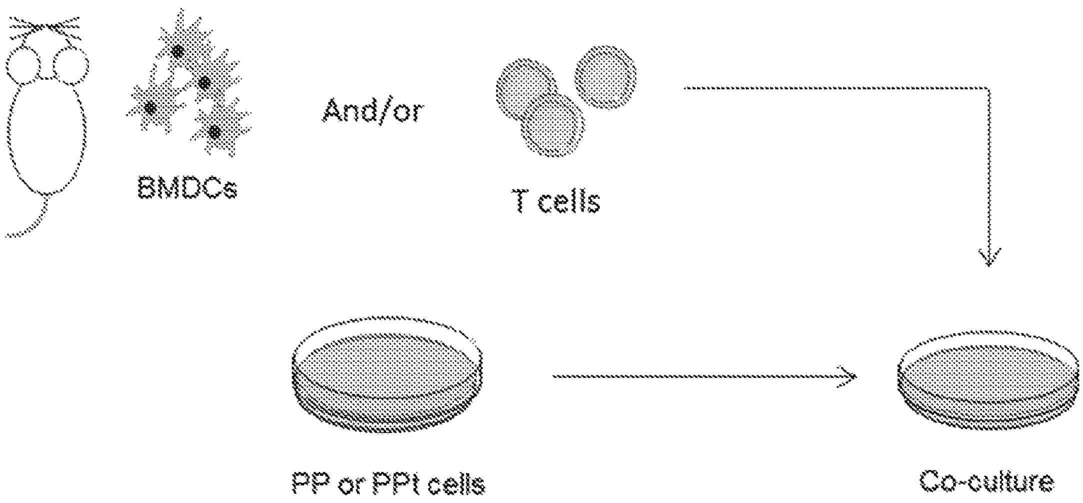
Figure 4G:
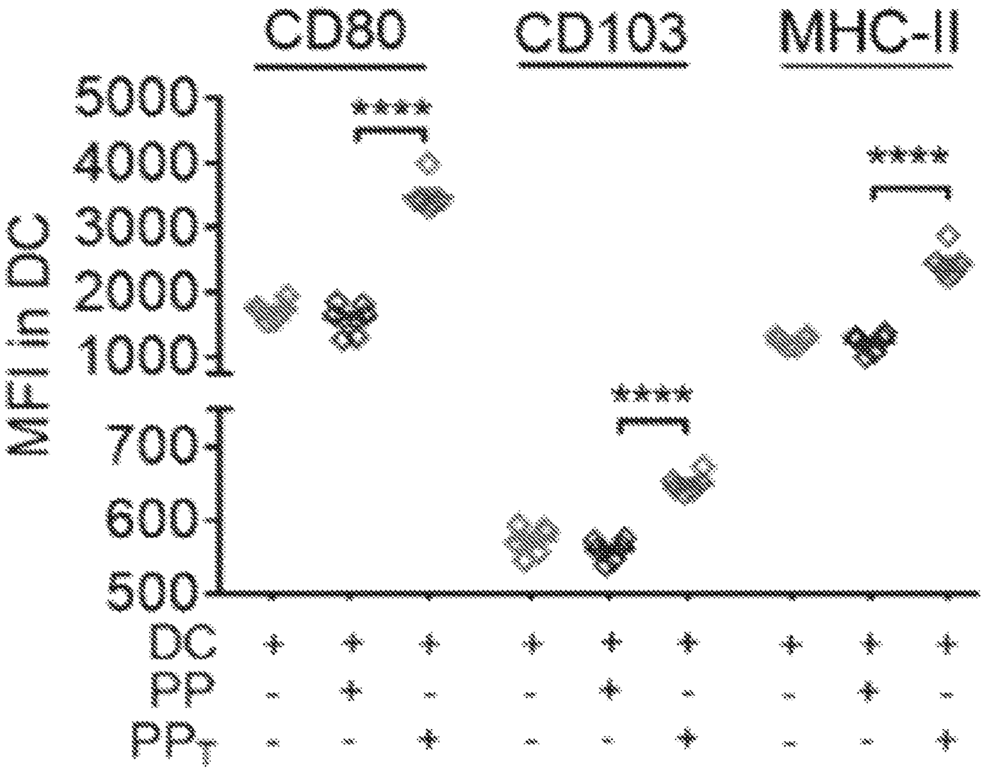
Figure 4H:
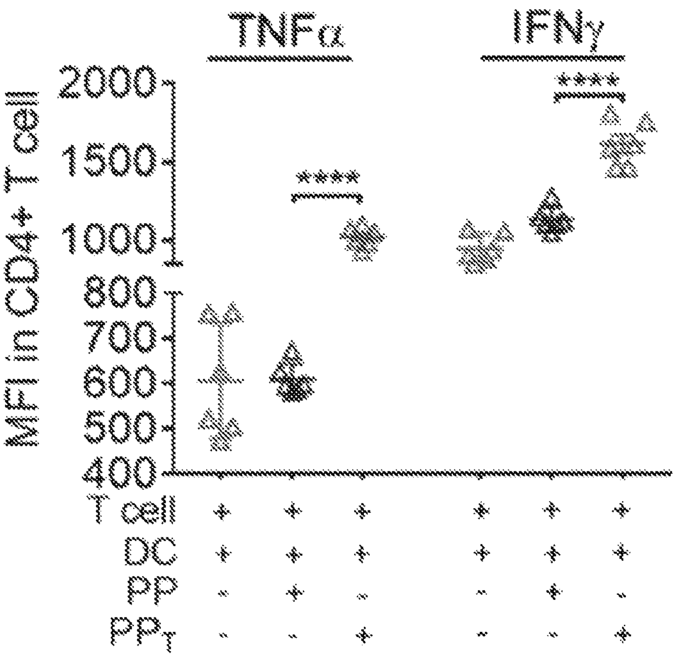
Figure 4I:
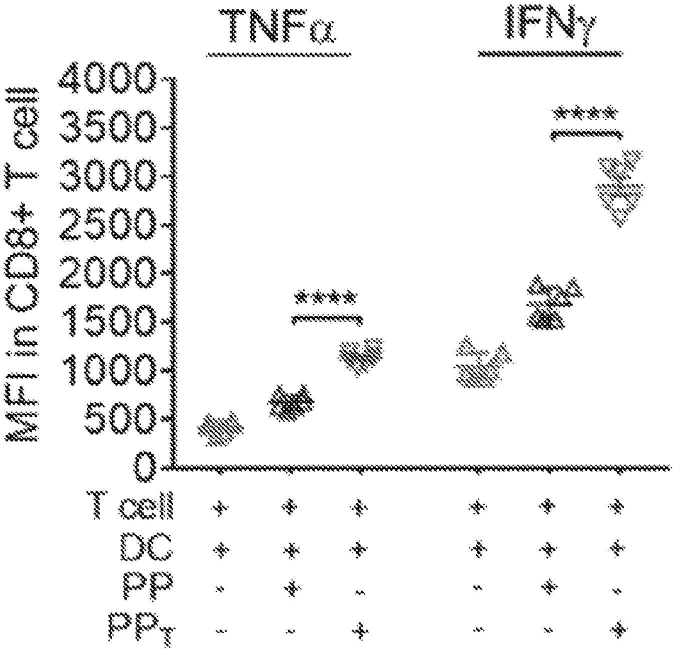
Figure 5C:
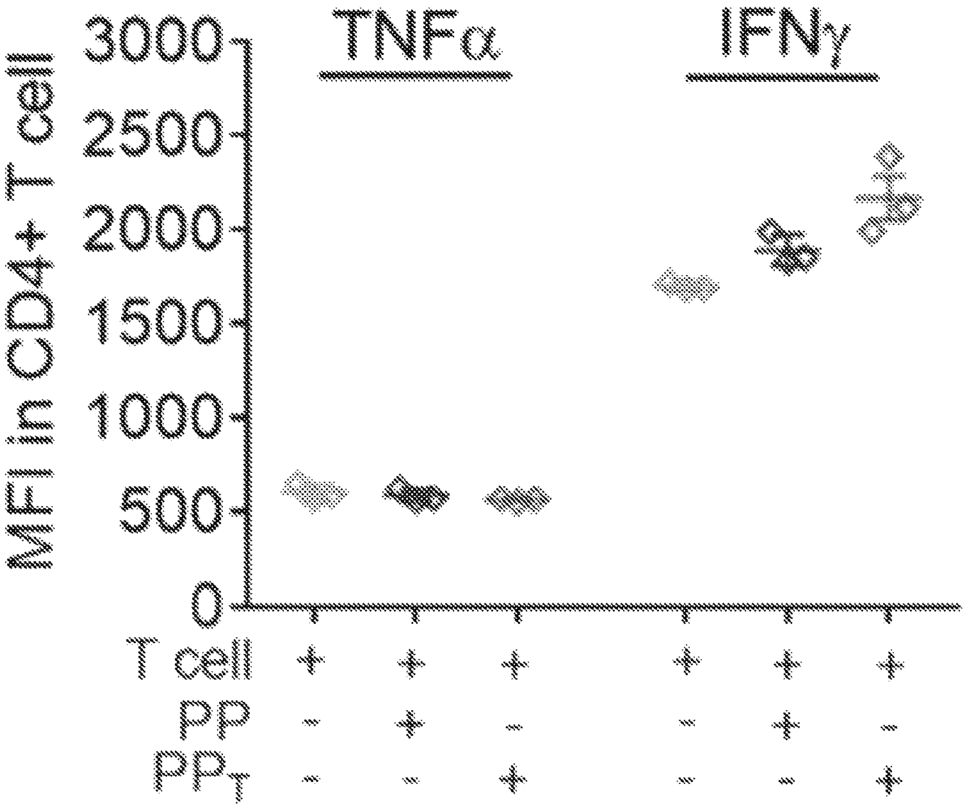
Figure 5D:
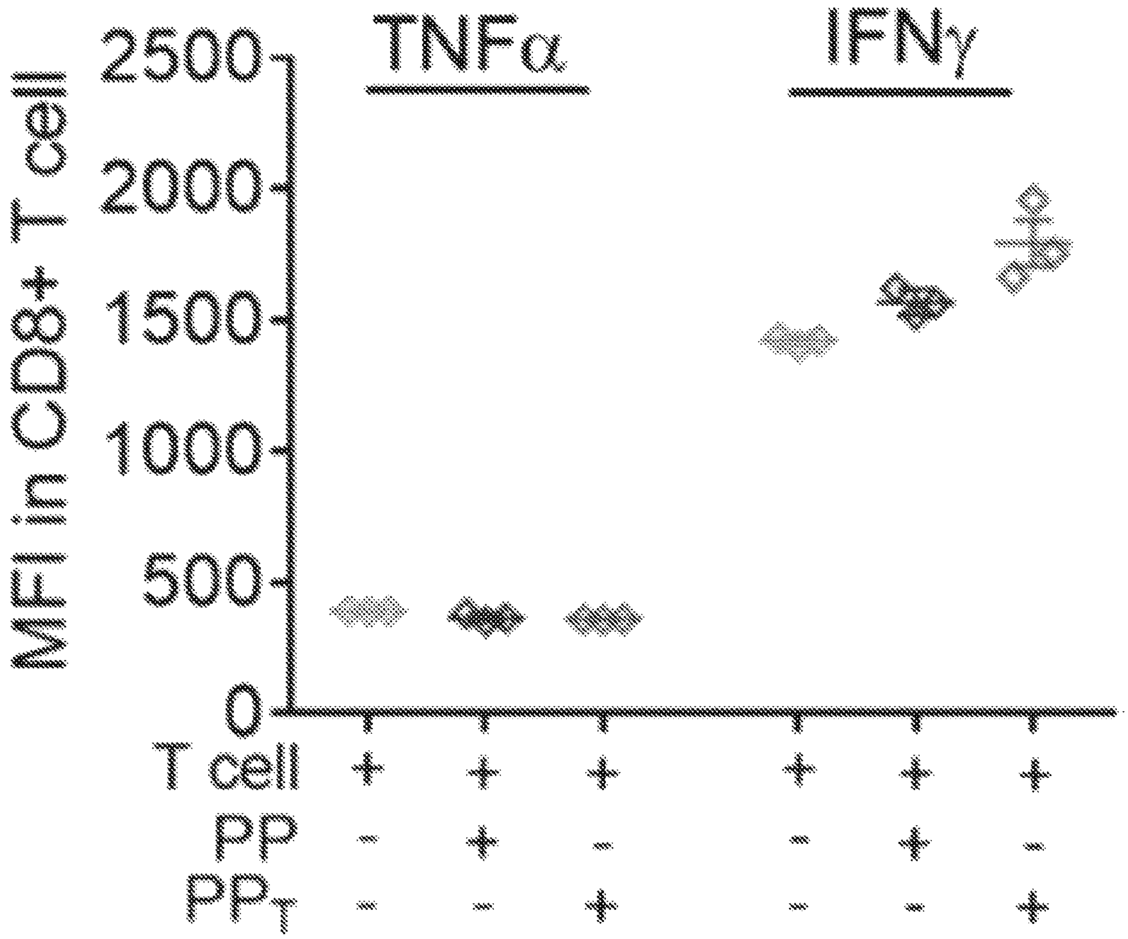
Figure 17:
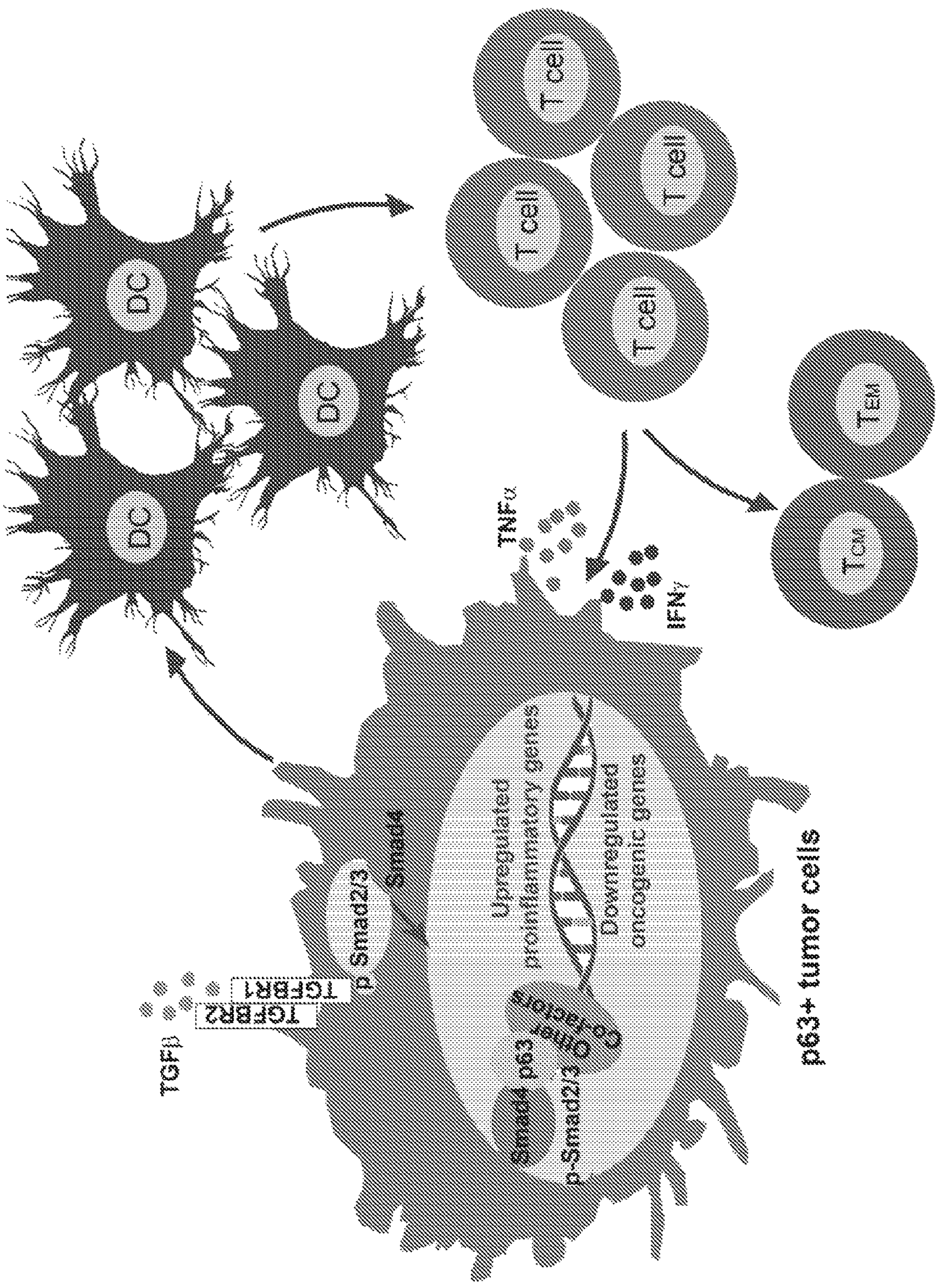
FIG. 17 shows that TGFβ activation in tumor cells induced anti-tumor immune response by engagement of dendritic cells and subsequent T cell activation. In p63-positive tumor cells, TGFβ induces Smad nuclear localization and promote the formation of a p63 and Smad transcriptional complex that upregulates multiple immune regulatory pathways and downregulates several major oncogenic signaling pathways, thereby triggering antitumor immunity through activation of dendritic cells (DCs) and T cells.

To delineate how $PP_T$ tumor cells elicit antitumor immunity when they are introduced into immune competent host animals, co-culture experiments of PP or $PP_T$ tumor cells with DCs or T cells in vitro were performed. Co-culture of bone marrow-derived DCs (BMDCs) obtained from naïve mice with tumor cells revealed that $PP_T$ cells, but not PP, were able to activate BMDCs (FIGS. 4F and 4G). A similar co-culture of T cells isolated from the spleen of naïve FVB mice with tumor cells showed that T cells were not activated when they were co-cultured with either PP or $PP_T$ cells (FIGS. 5C and 5D). However, in the presence of DCs, both CD4+ and CD8+ T cells were activated by co-culturing with $PP_T$ cells, but not with PP cells (FIGS. 4H and 4I). These results indicate that $PP_T$ cells trigger activation of DCs to mount an adaptive immune response, which in turn primes T cells to target $PP_T$ tumor cells (FIG. 17).

Figure 6A:
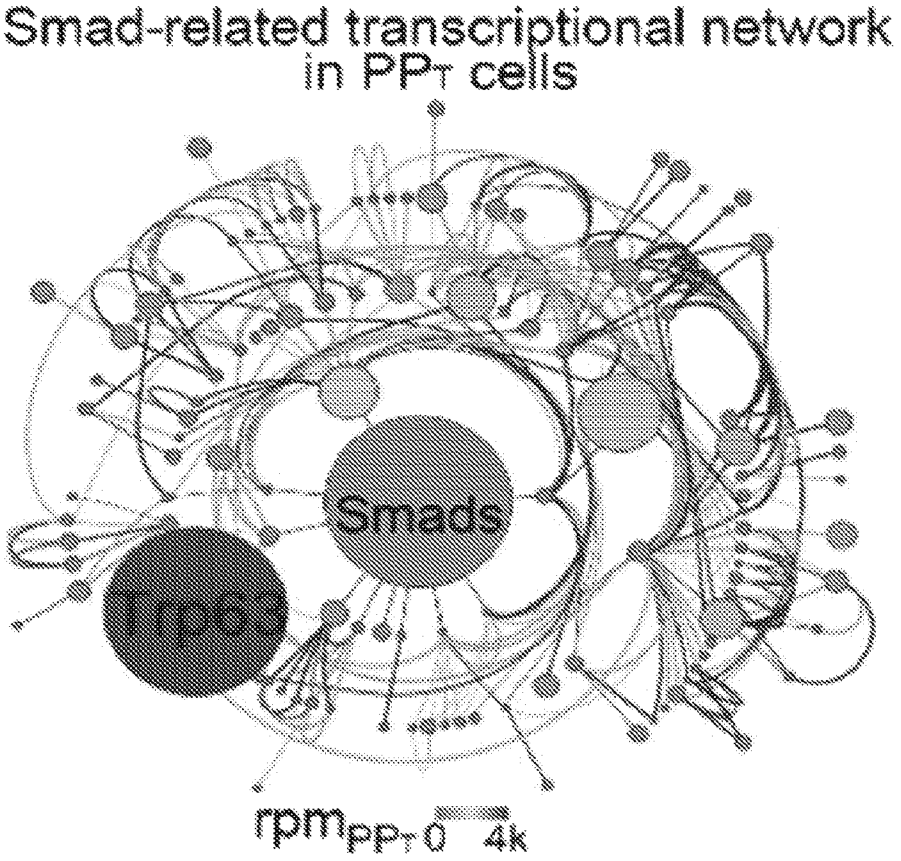
FIG. 6A-FIG. 6C show Smad2/p63 complex-mediated antitumor immunity induced by TGFβ.
Figure 6B:
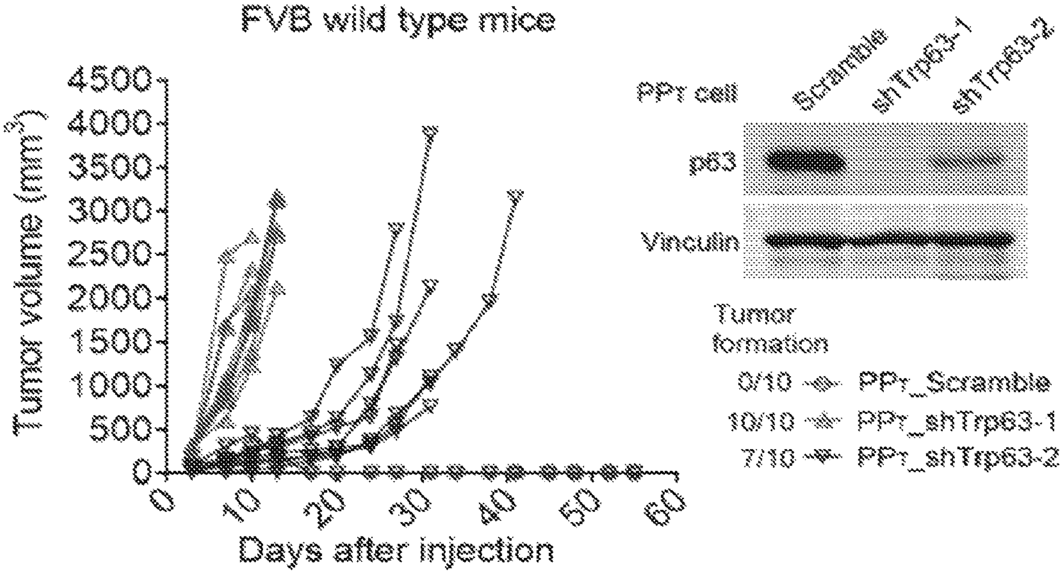
Figure 6C:
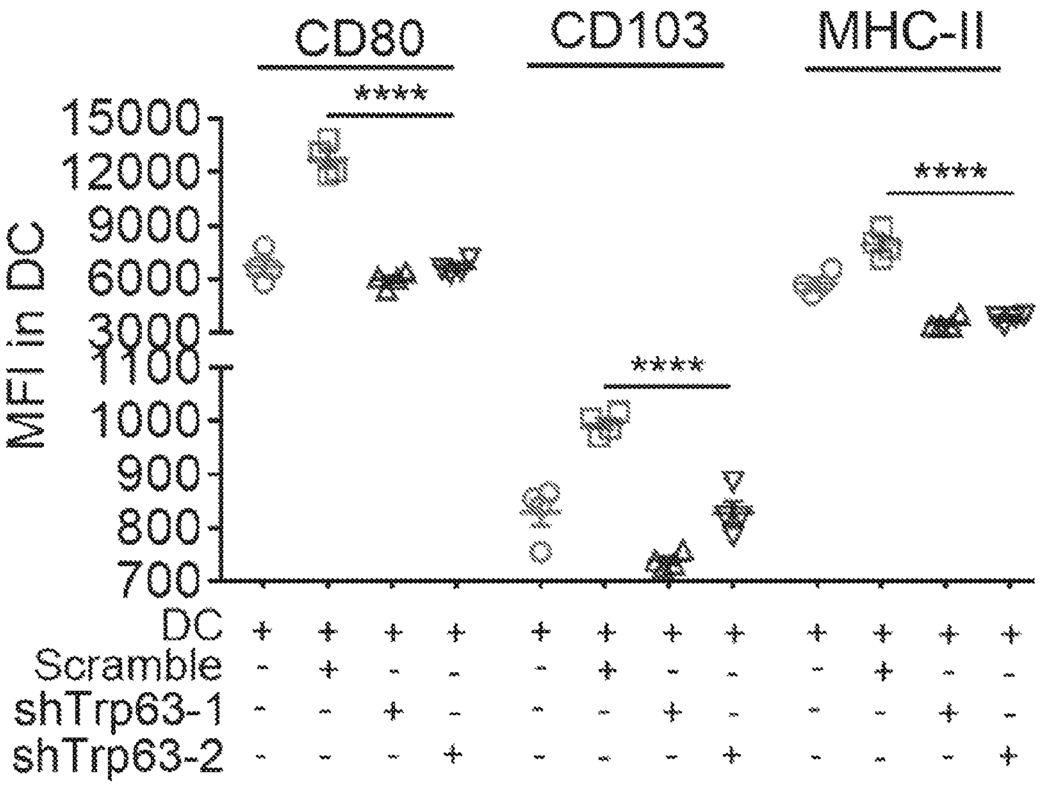

Example 4: TGFβ Stimulates Antitumor Immunity Through the TGFβ-Smad/p63 Signaling Axis The molecular mechanisms by which prolonged treatment of tumor cells with TGFβ could enhance immunogenicity to the extent observed in $PP_T$ cells were next determined. Since Smad proteins are specific transcriptional effectors of TGFβ signaling (Xu et al. (2016) *Cold Spring Harb. Perspect. Biol.* 8: a022087; Budi et al. (2017) *Trends Cell Biol.* 27:658-672; Cantelli et al. (2017) *Semin. Cancer Biol.* 42:60-69), the expression levels of Smads and Smad-related transcription factors in $PP_T$ cells were analyzed by transcriptome profiling. Notably, the expression level of p63 (encoded by Trp63 in mice) was highest among the Smad-associated transcriptional networks (FIG. 6A). The transcription factor p63 is a member of the p53 family, which has been reported to either suppress or promote tumor progression depending on the cellular context (Bergholz and Xiao (2012) *Cancer Microenviron.* 5:311-322; Adorno et al. (2009) *Cell* 137:87-98; Memmi et al. (2015) *Proc. Natl. Acad. Sci. U.S.A.* 112:3499-3504; Chen et al. (2018) *Cell Mol. Life Sci.* 75:965-973; Yoh et al. (2016) *Proc. Natl. Acad. Sci. U S. A.* 113:E6107-E6116). To determine the role of p63 in $PP_T$ cells, p63 was depleted via short hairpin RNA (shRNA) and p63-knockdown $PP_T$ cells were transplanted into FVB mice. Remarkably, while $PP_T$ cells expressing a control shRNA failed to form tumors, $PP_T$ cells expressing shTrp63-1 and undetectable p63 protein levels quickly formed tumors with full penetrance (FIG. 6B). $PP_T$ cells expressing shTrp63-2 with still detectable p63 formed tumors with a longer latency and reduced penetrance (70%) than that of cells expressing shTrp63-1 (FIG. 6B). Moreover, $PP_T$ cells expressing either shTrp63-1 or shTrp63-2 lost the capacity to activate BMDCs in co-culture systems (FIG. 6C). These results indicate that p63 plays a critical role in mediating enhanced immunogenicity and immune sensitization induced by TGFβ treatment, which then results in failure to evade immune attack and loss of tumorigenicity.

Figure 7A:
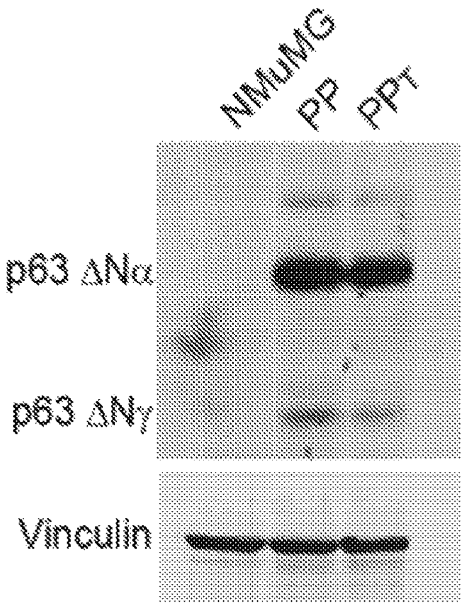
FIG. 7A-FIG. 7D show that TGFβ induced Smad2/p63 complex formation in $PP_T$ cells.
Figure 7B:
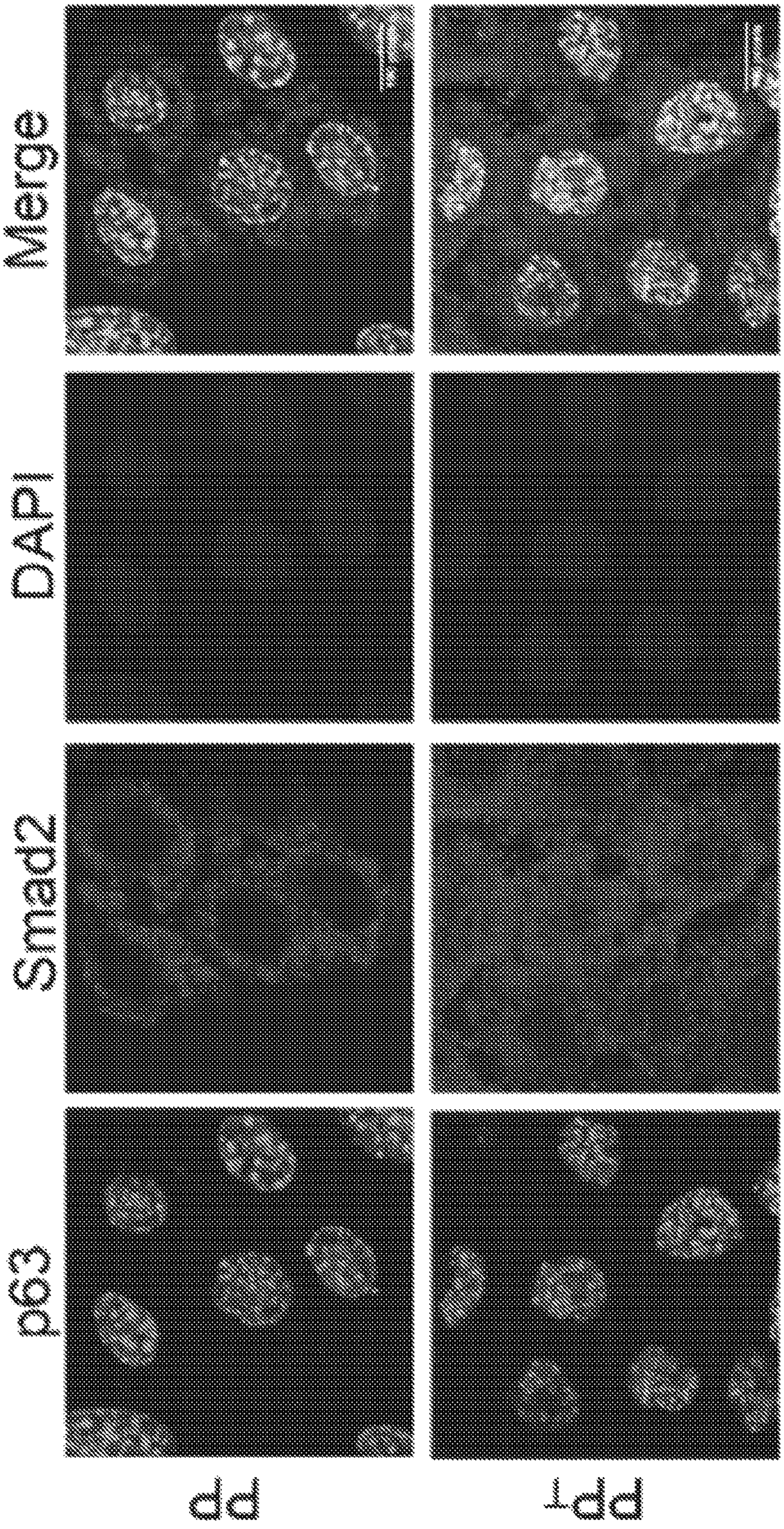
Figure 7C:
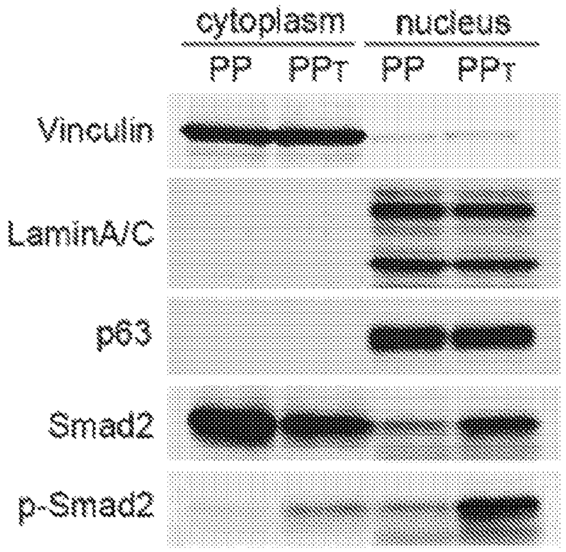
Figure 7D:
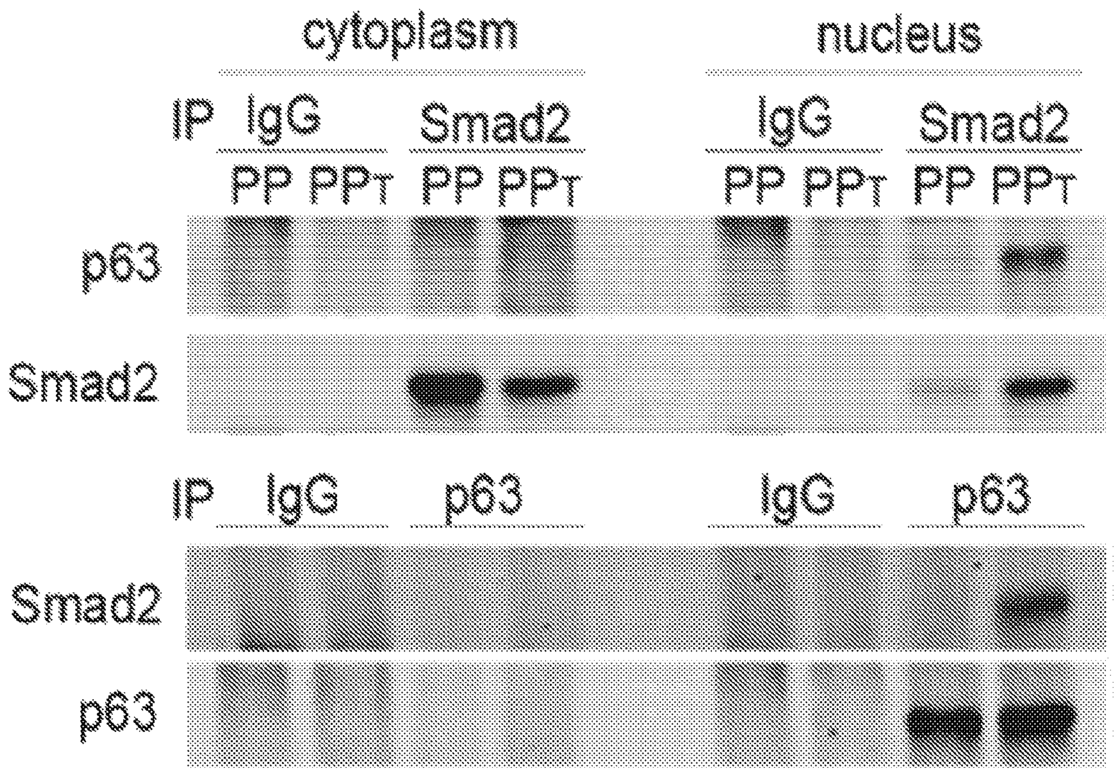

Intriguingly, both PP and $PP_T$ cells express an abundant amount of p63 (FIG. 7A). To investigate why and how p63 plays a different role in PP and $PP_T$ cells, immunofluorescence analysis was performed to detect the cellular localization of p63 and Smad2. Results showed that while p63 was in the nucleus in both PP and $PP_T$ cells, Smad2 was restricted to the cytoplasmic compartment in PP cells, but localized to both the cytoplasm and nucleus in $PP_T$ cells (FIG. 7B). The cellular localization of p63 and Smad2 was validated by cellular fractionation (FIG. 7C), and their association in the nucleus of $PP_T$ cells was confirmed by co-immunoprecipitation (FIG. 7D). These data indicate that p63 can act as a co-factor of the nuclear Smads to target specific sets of genes for transcriptional regulation upon TGFβ treatment.

Figure 8A:
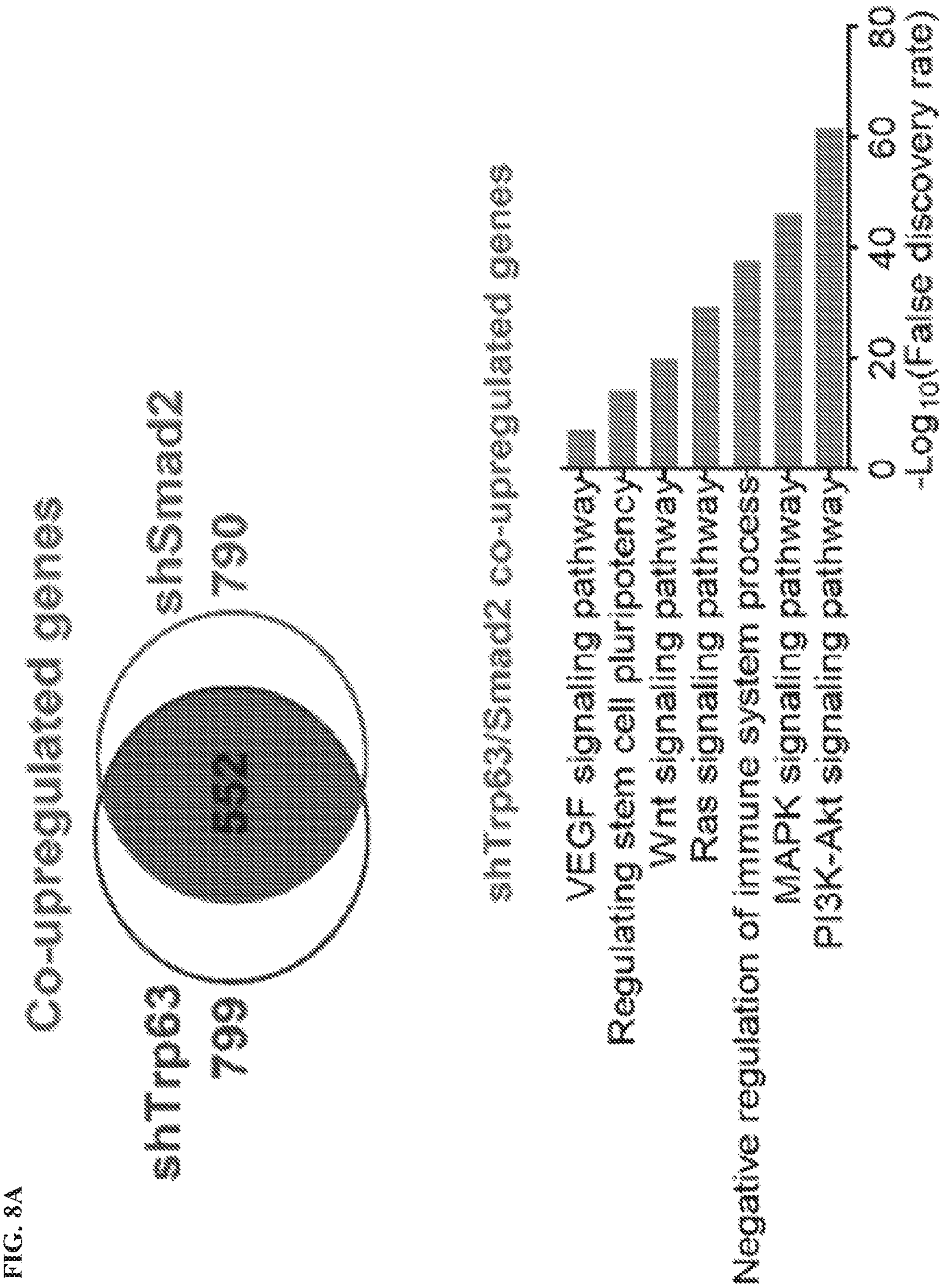
FIG. 8A-FIG. 8D show that TGFβ reprogramed PP cells through the p63/Smad2 signaling pathway. Genes that were co-upregulated (FIG. 8A) and co-downregulated (FIG. 8B) by knocking down of Smad or p63 were determined by comparing transcriptomes in control, p63- and Smad2-knockdown $PP_T$ cells. Relevant GO terms and KEGG pathways (lower panels) are also shown. Relevant targets co-upregulated (FIG. 8C) and co-downregulated (FIG. 8D) by p63 or Smad2 knockdown in $PP_T$ cells are shown by heat maps.
Figure 8B:
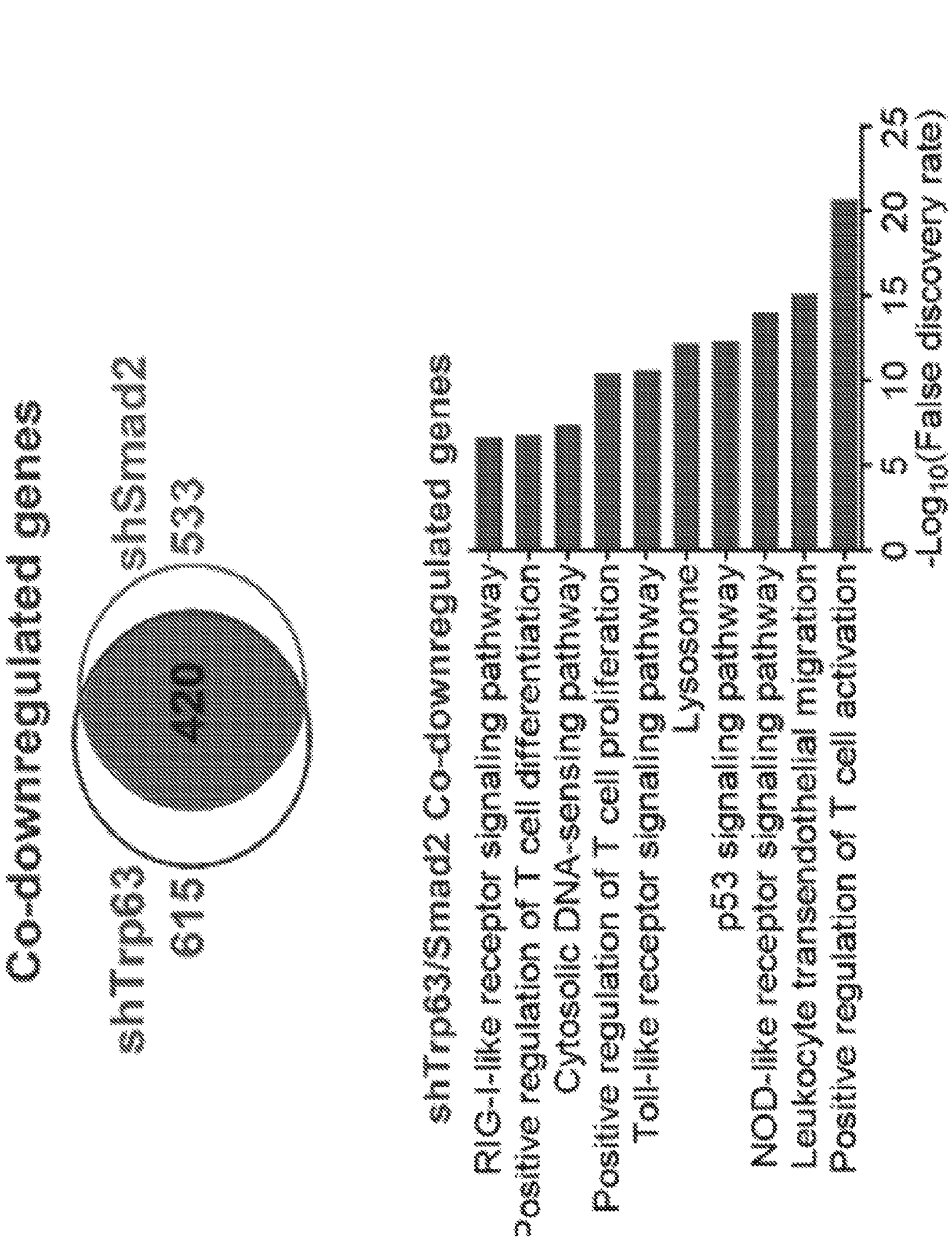
Figure 8C:
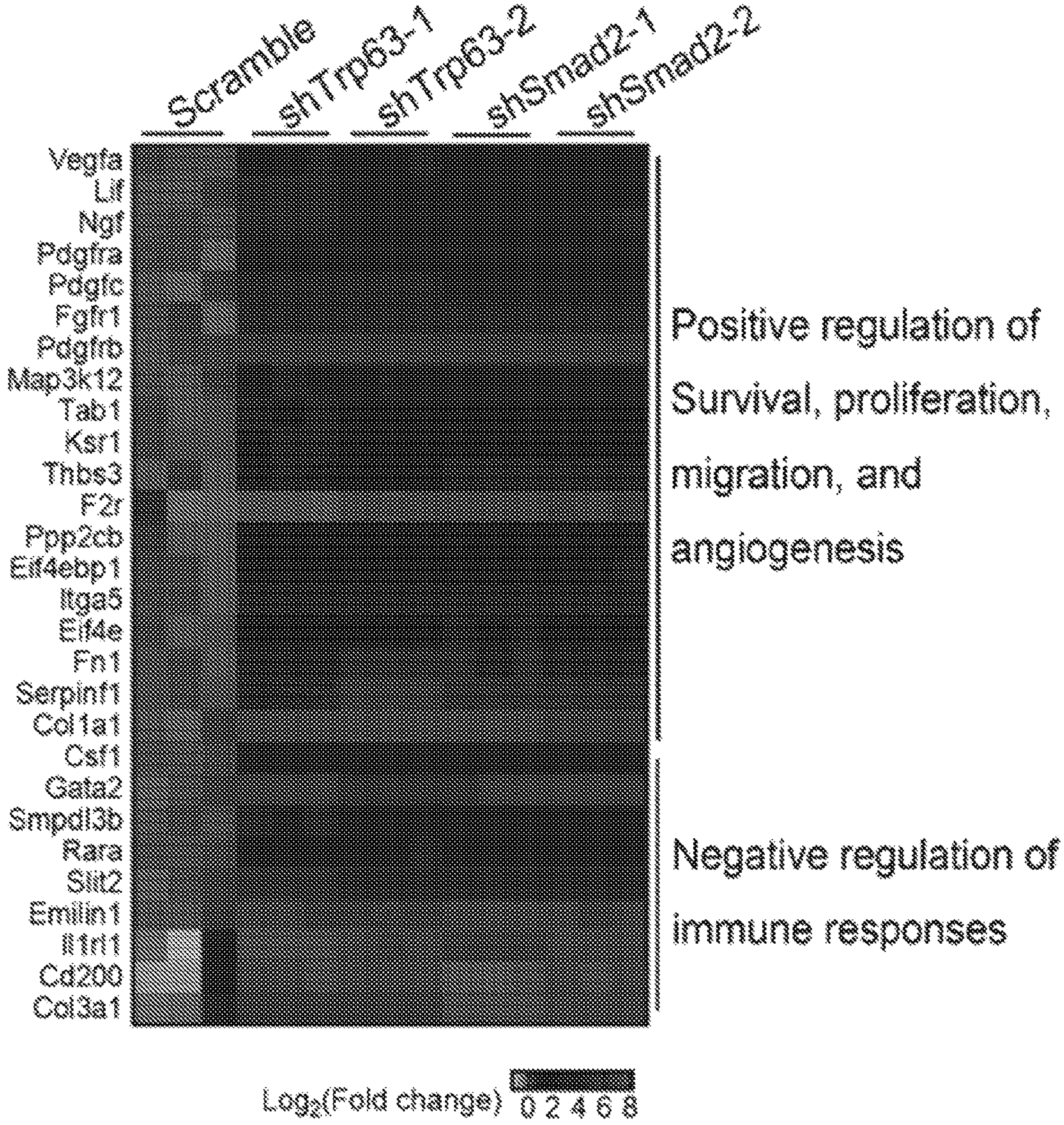
Figure 8D:
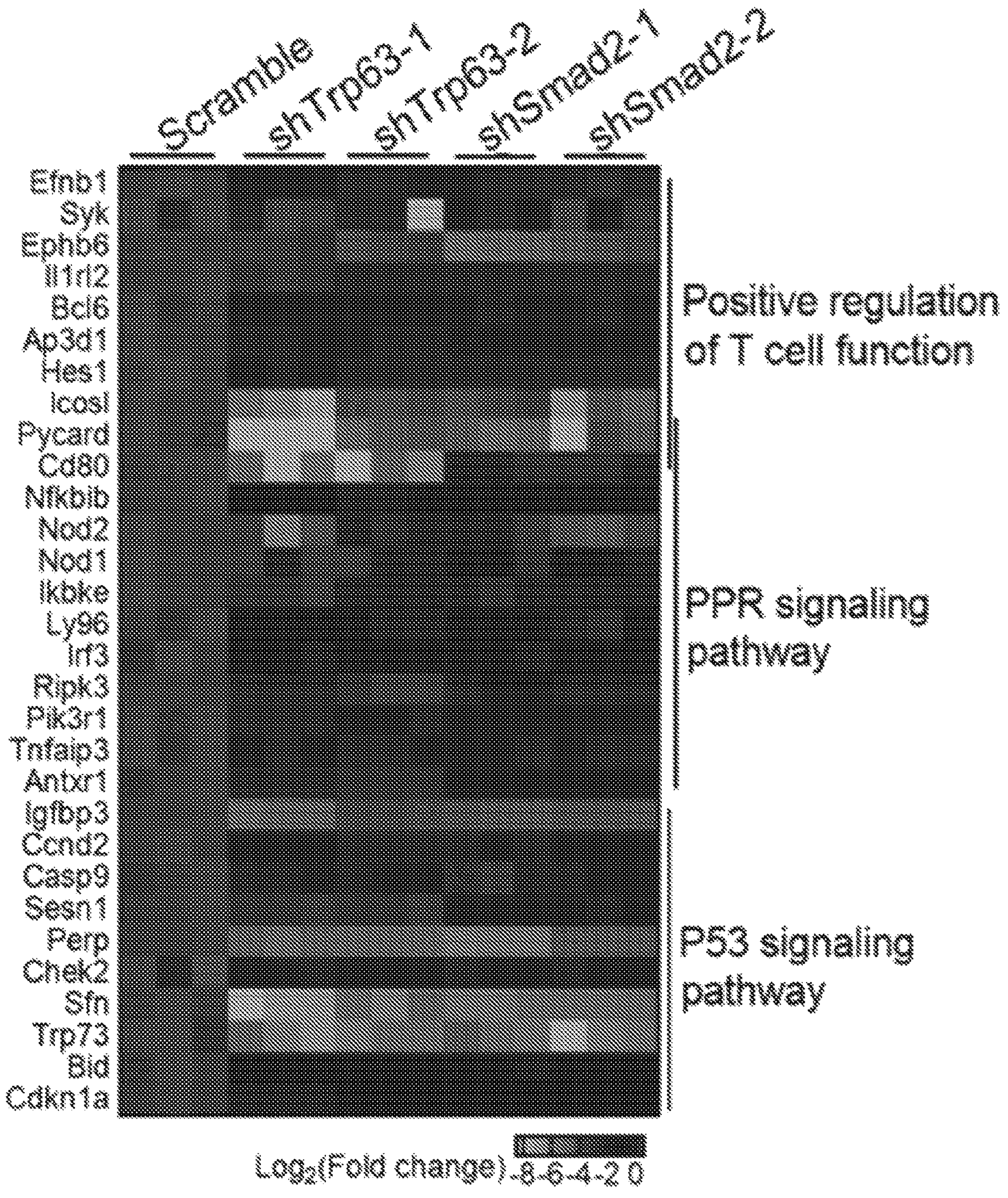

To determine transcriptional programs co-regulated by p63 and Smad2, transcriptome analysis of $PP_T$ cells with shRNA-mediated silencing of p63 or Smad2 expression was performed. Approximately 70% of altered genes in $PP_T$ cells expressing shTrp63 or shSmad2 were regulated in common by p63 and Smad2 (FIGS. 8A and 8B). Notably, while multiple major oncogenic signaling pathways were up-regulated in both shTrp63- and shSmad2-expressing $PP_T$ cells, many immune regulatory pathways were down-regulated (FIGS. 8C and 8D).

Figure 9A:
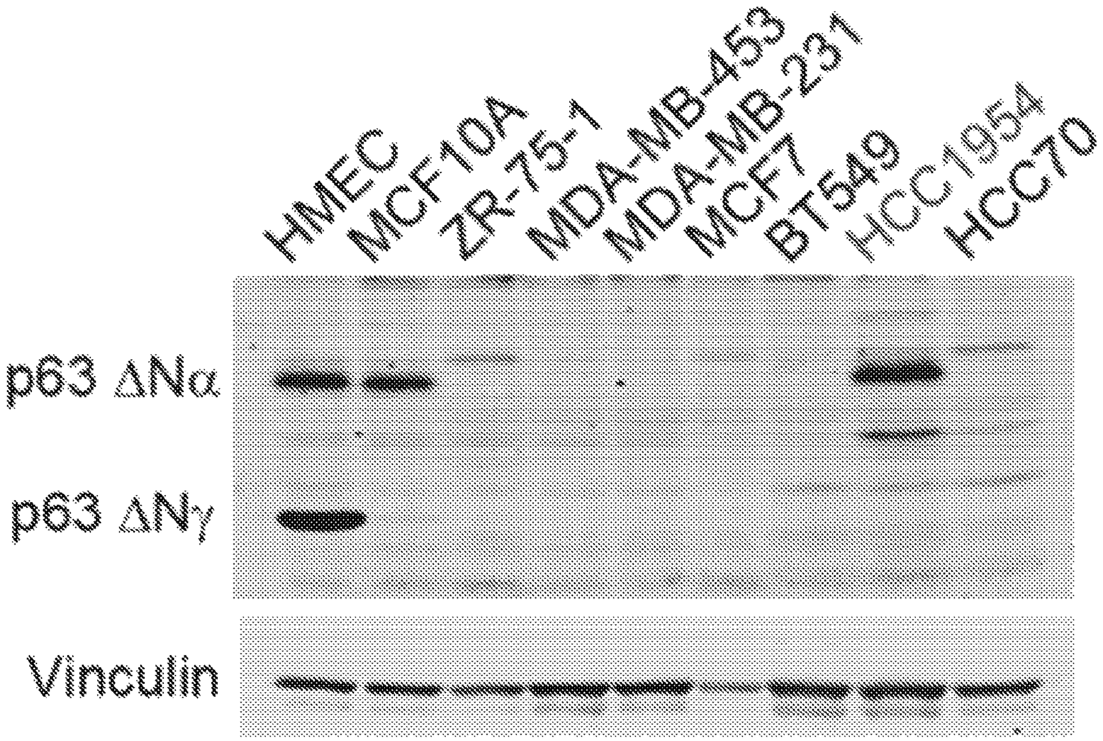
FIG. 9A-FIG. 9F show that TGFβ activated antitumor immunity in a p63-dependent manner in human breast cancer cells.
Figure 9B:
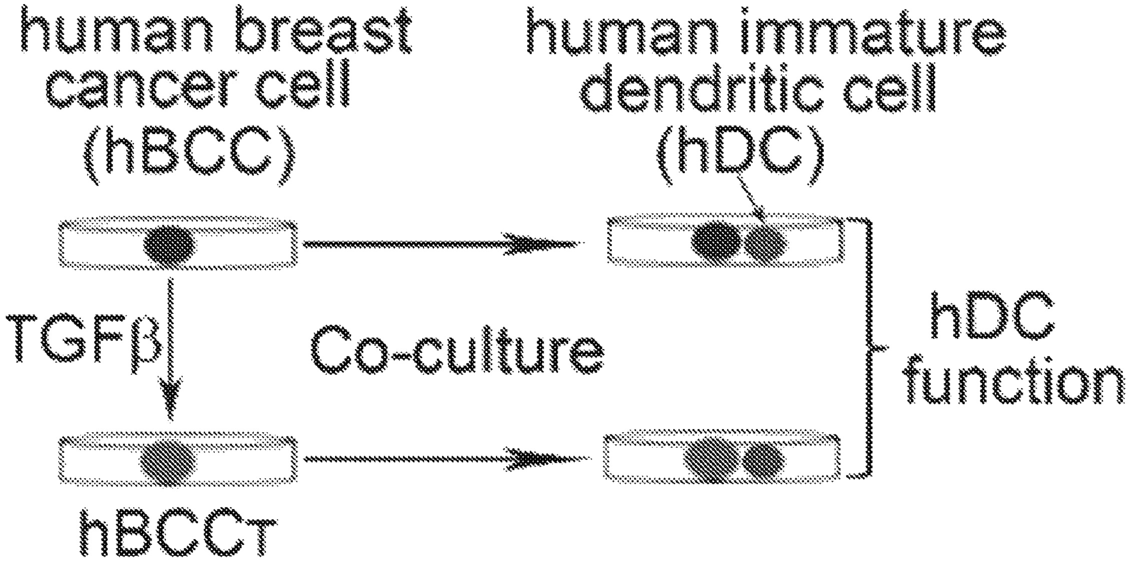
Figure 9C:
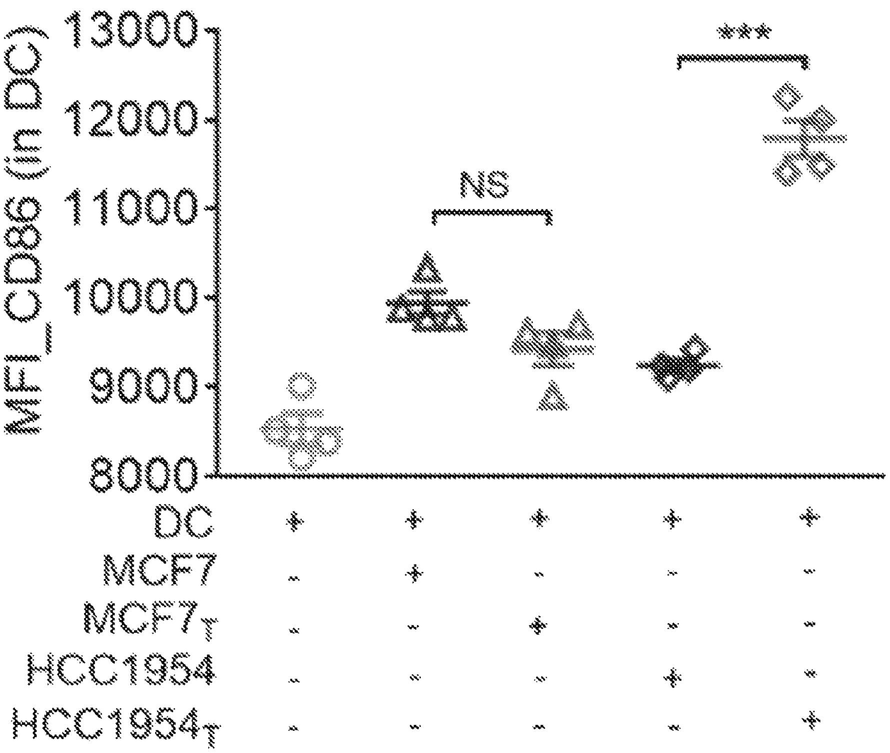
Figure 9D:
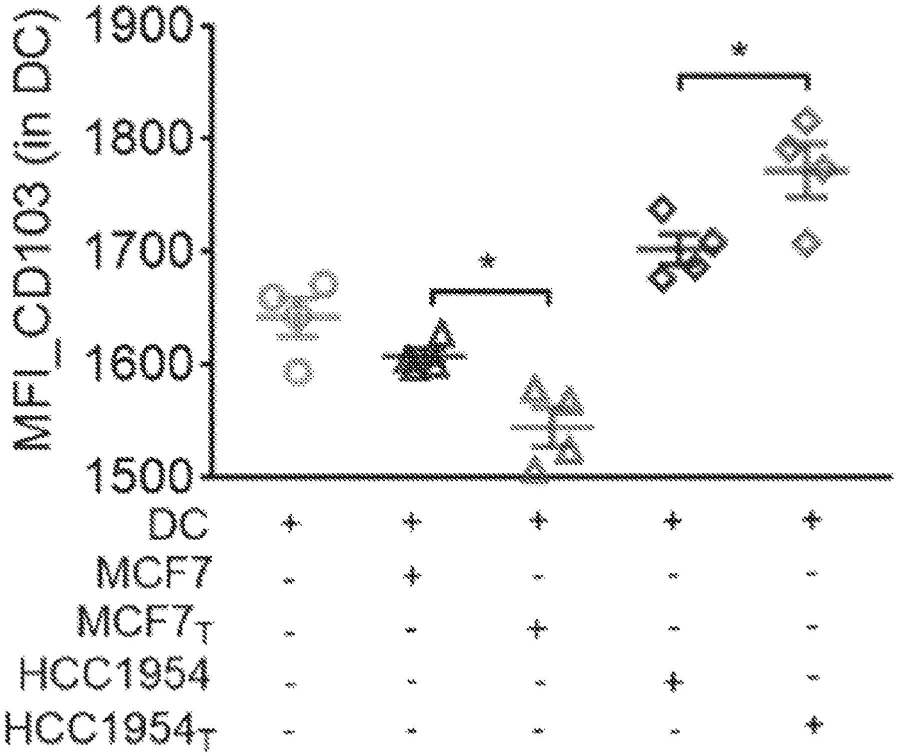
Figure 9E:
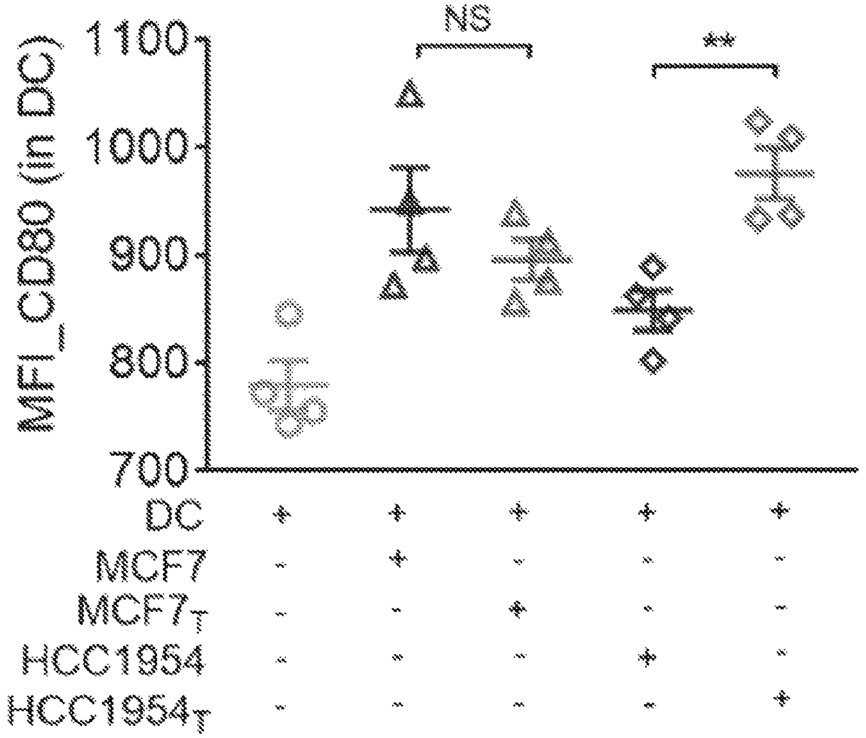
Figure 9F:
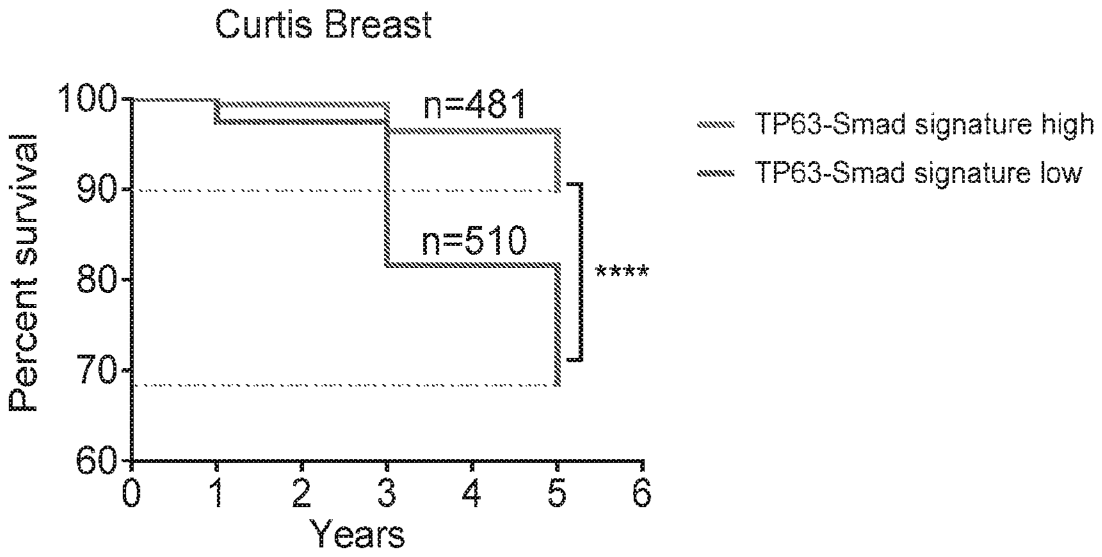

Example 5: TGFβ-Smad/p63 Signaling Activation Reprogramed Human Tumor Cells to Activate DCs in a Similar Fashion To determine whether TGFβ-Smad/p63 pathway was also important in the interaction of human tumor cells with the immune system, a panel of breast cancer cell lines was screened and it was found that most of these cell lines do not express p63. Only HCC1954 and the two non-cancer cell lines screened express p63 at levels detectable by western blotting (FIG. 9A). HCC1954 and MCF7 cells were treated with TGFβ and co-cultured with human DCs (FIG. 9B). Consistent with previous results, only HCC1954 cells, but not MCF7, were able to induce DC activation upon TGFβ-treatment (FIGS. 9C-9E). These data indicate that the TGFβ-Smad/p63 signaling activation can also reprogram human tumor cells to activate DCs in a similar fashion. More importantly, breast cancer patients with a higher level of the TP63/Smad-based gene expression signature had much better survival outcome than those patients with a lower level of TP63/Smad-based gene signature (FIG. 9F).

Figure 10A:
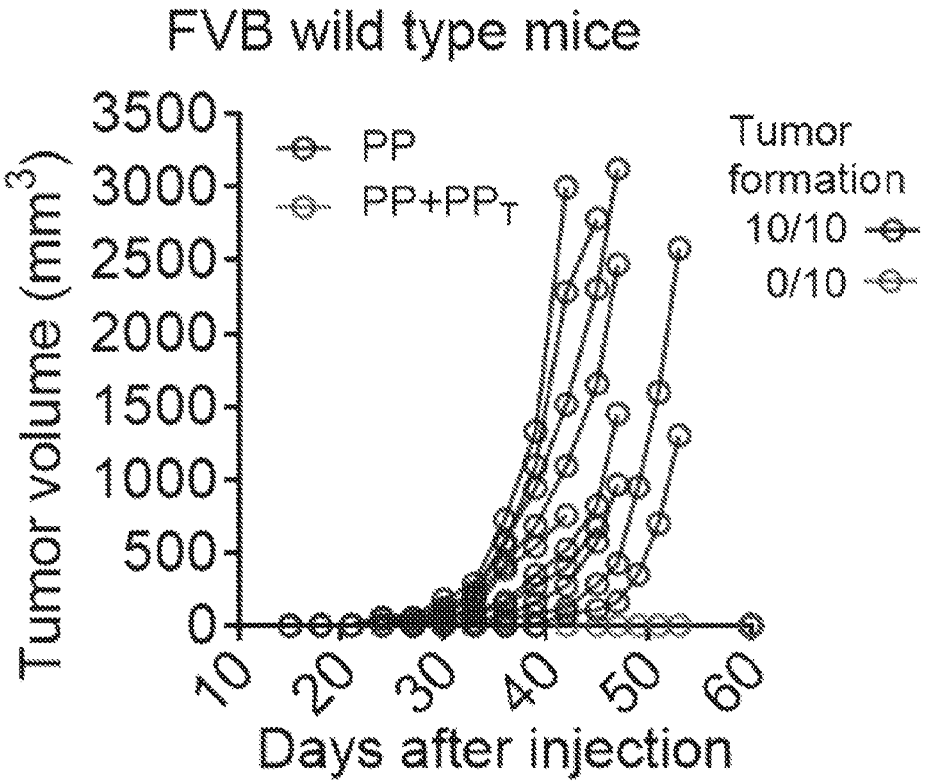
FIG. 10A-FIG. 10B show that PP tumor cells failed to grow when co-injected with $PP_T$ into syngeneic mice. PP and $PP_T$ cell mixtures (1:1) were injected into syngeneic mice. Tumor growth (FIG. 10A; n=10 per group) and long-term survival (FIG. 10B; n=5 per group) are shown.
Figure 10B:
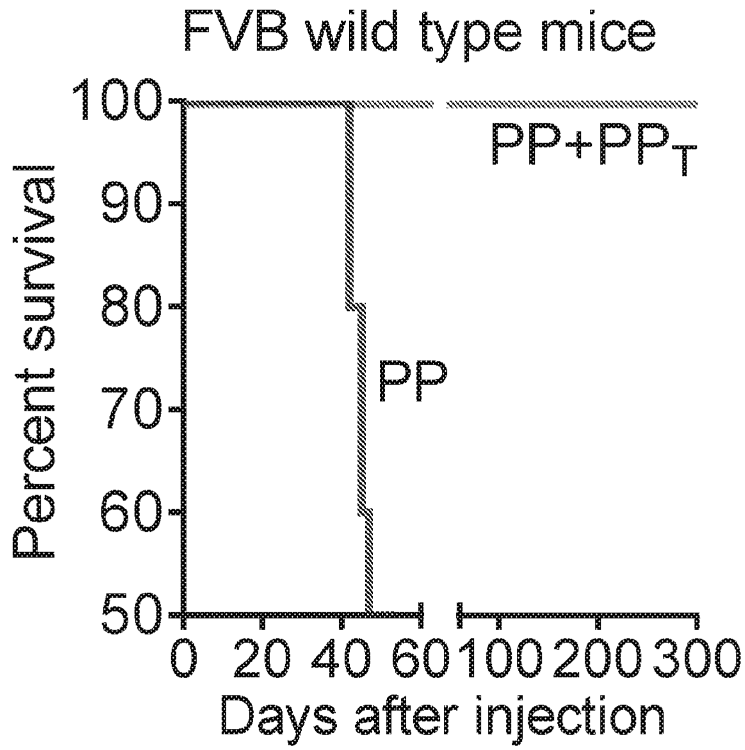

Example 6: $PP_T$ Cells have Therapeutic Effect on Blocking the Growth of their Parental PP Tumor Cells It was determined whether the enhanced immune response elicited by $PP_T$ cells can extend its cytotoxic effects towards non-TGFβ-treated parental PP tumor cells, which can lead to important therapeutic implications for cancer treatment. Remarkably, co-injection of $PP_T$ cells with PP tumor cells into FVB mice completely abrogated growth of PP tumors (FIGS. 10A and 10B). The results indicated that $PP_T$ induced antitumor immunities against its parental PP tumor cells.

Figure 11A:
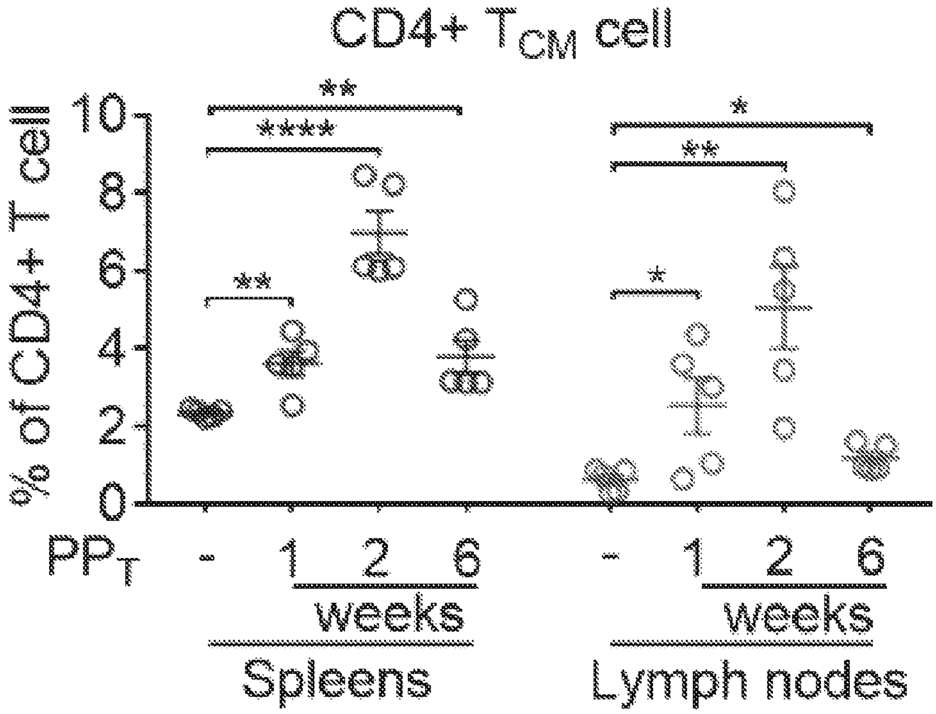
FIG. 11A-FIG. 11D show that immunization with TGFβ-activated tumor cells induced immune memory response. Spleens and lymph nodes were collected at week one, two, and six after injection of $PP_T$ cells. Proportions of CD45+CD3+CD4+FOXP3-CD44+KLRG1-CD62L+ central memory T cells (CD4+ $T_{CM}$ cells) (FIG. 11A), CD45+CD3+CD4+FOXP3-CD44+KLRG1+CD62L− effector memory T cells (CD4+ $T_{EM}$ cells) (FIG. 11B), CD45+CD3+CD8+FOXP3-CD44+KLRG1-CD62L+ central memory T cells (CD8+ $T_{CM}$ cells) (FIG. 11C), and CD45+CD3+CD8+FOXP3-CD44+KLRG1+CD62L− effector memory T cells (CD8+ $T_{EM}$ cells) (FIG. 11D) were analyzed by flow cytometry. *indicates P<0.05, indicates P<0.01, *indicates P<0.001, ****indicates P<0.0001; n=5 mice per group.
Figure 11B:
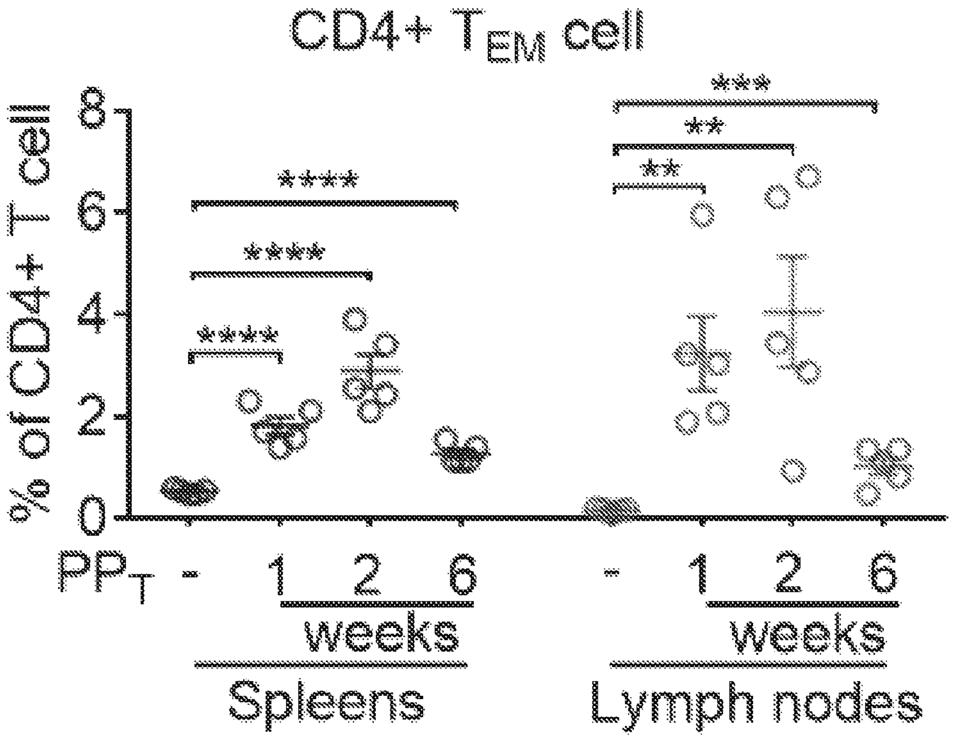
Figure 11C:
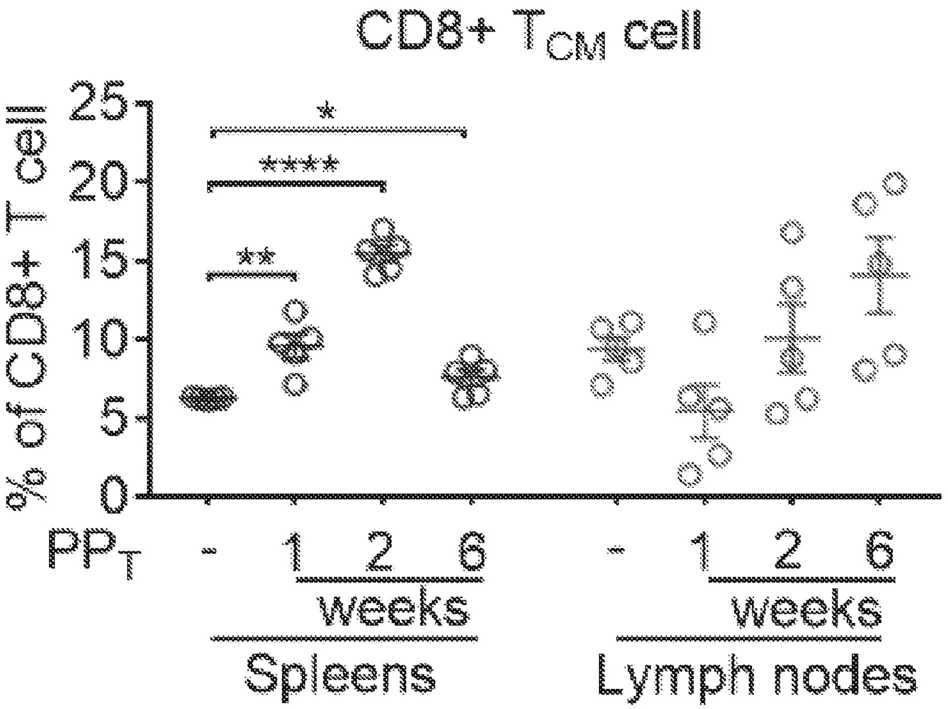
Figure 11D:
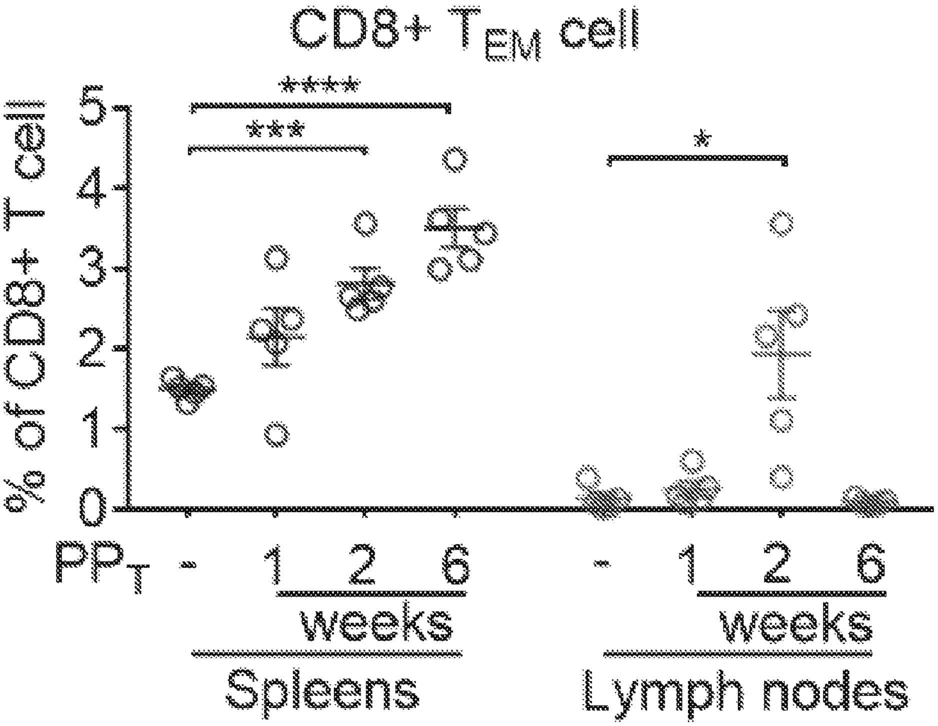

Example 7: $PP_T$ Cells have Potent Vaccine Activity Against Parental PP Tumor Cells Through Induction of Memory T Cell Responses To gain a further understanding on the antitumor immunity of $PP_T$ cells, it was determined whether $PP_T$ cells can induce tumor specific memory T cell responses. T cells harvested from the spleen and lymph nodes of $PP_T$-bearing mice at 1, 2 and 6 weeks after injection of $PP_T$ cells were analyzed, and it was found that both populations of CD4+ central memory ($T_{CM}$) and effector memory ($T_{EM}$) T cell were increased (FIGS. 11A and 11B) Increased long-term splenic CD8+ $T_{CM}$ and $T_{EM}$ cells were also observed in these mice after $PP_T$ cell injection (FIGS. 11C and 11D).

Figure 12A:
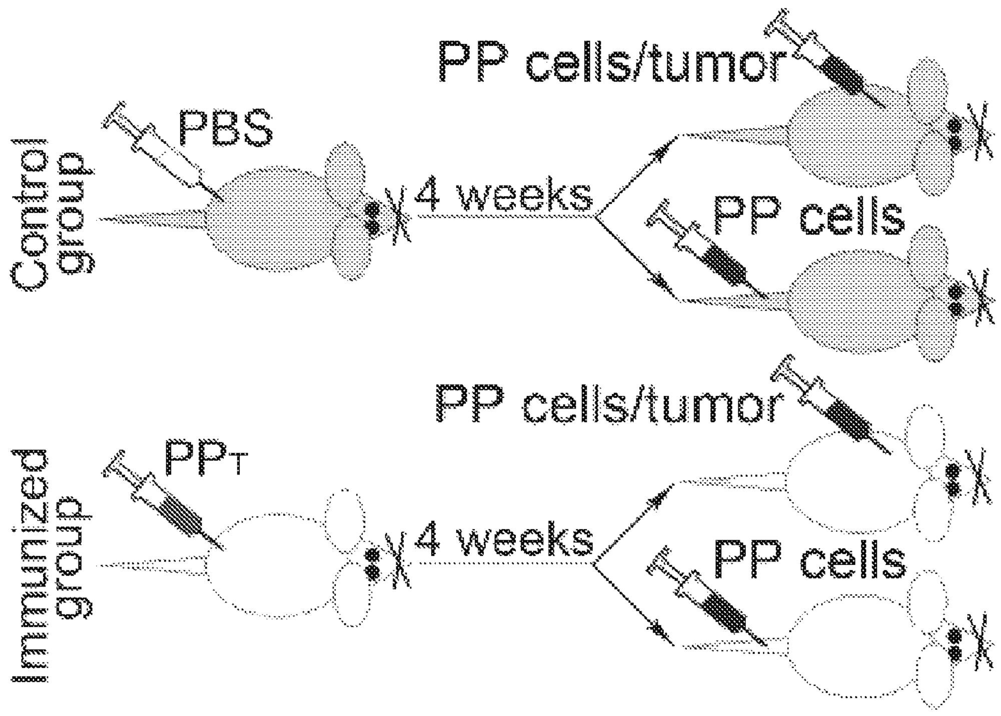
FIG. 12A-FIG. 12G show that immunization with TGFβ-activated tumor cells induced an immune memory response against parental tumors.
Figure 12B:
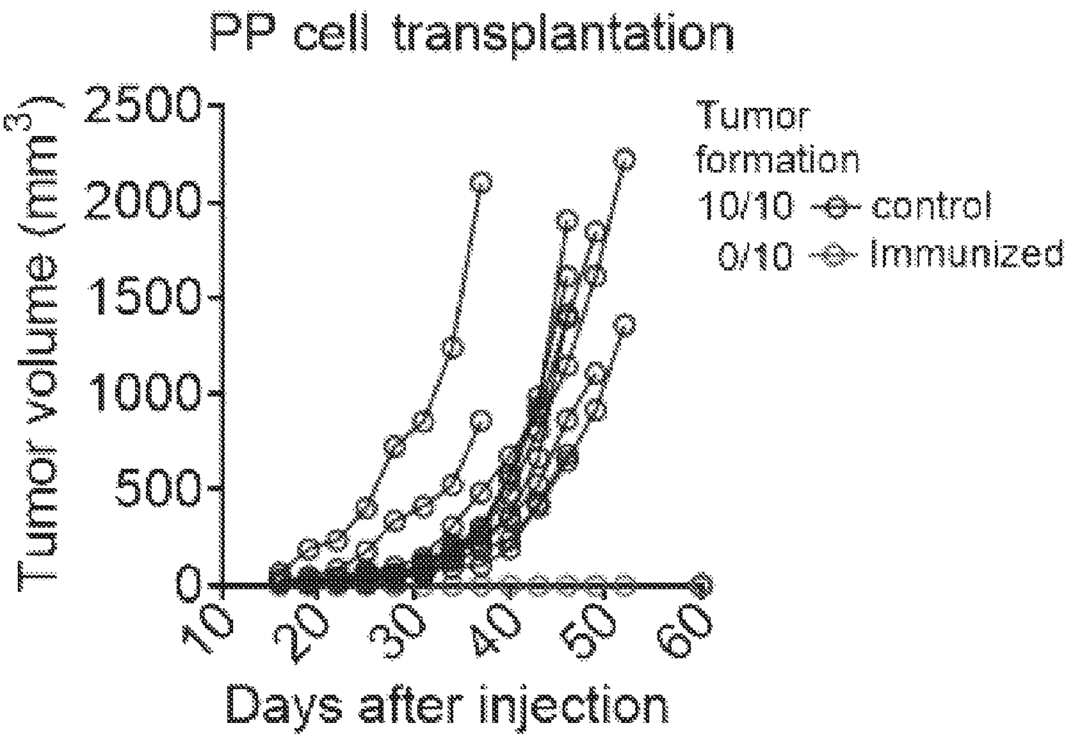
Figure 12C:
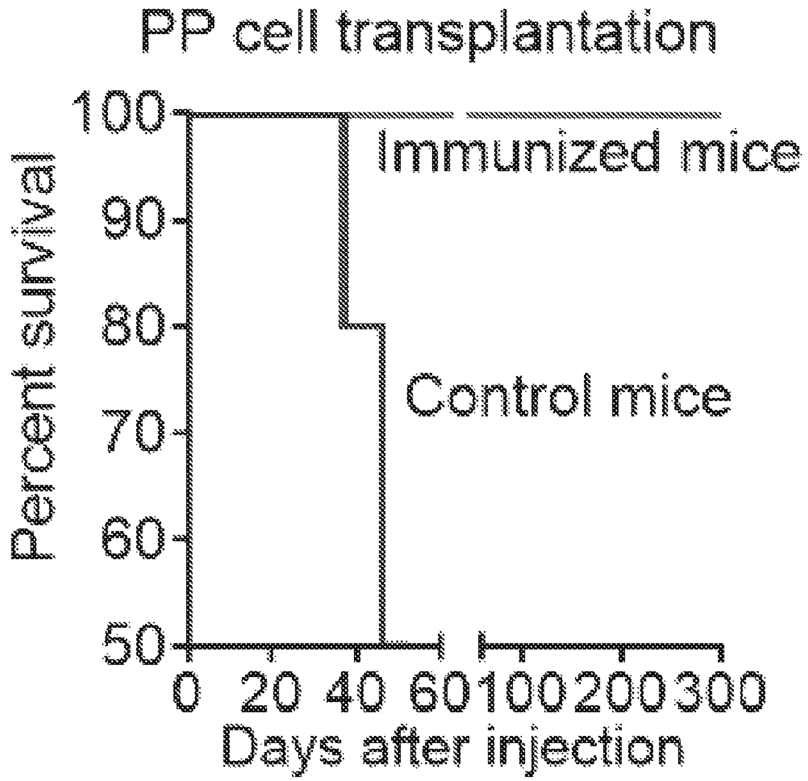
Figure 12D:
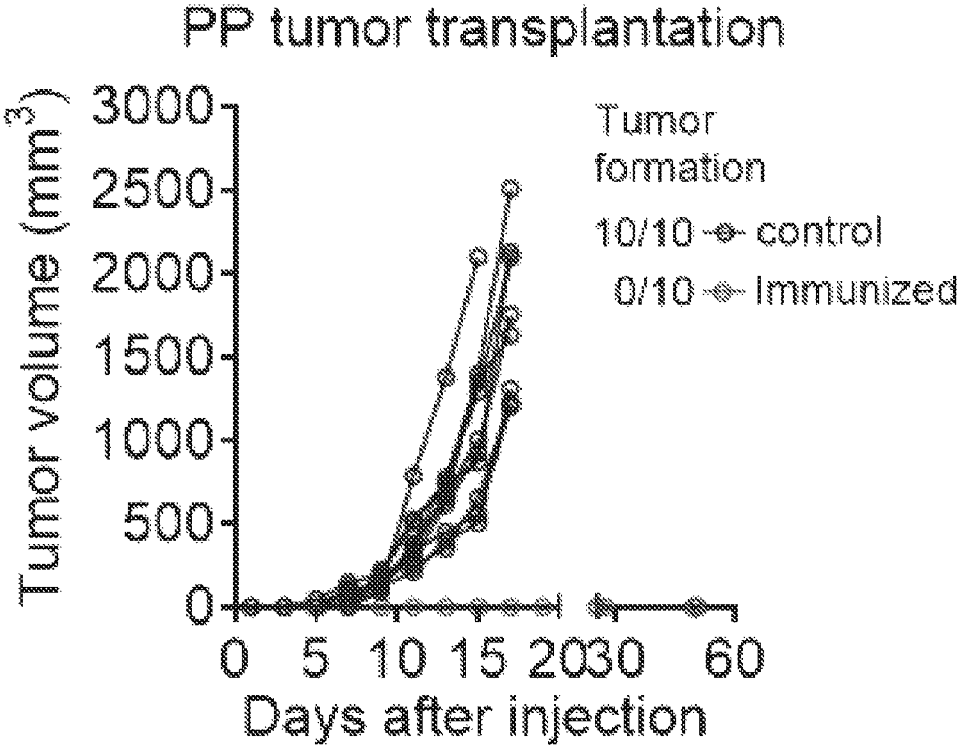
Figure 12E:
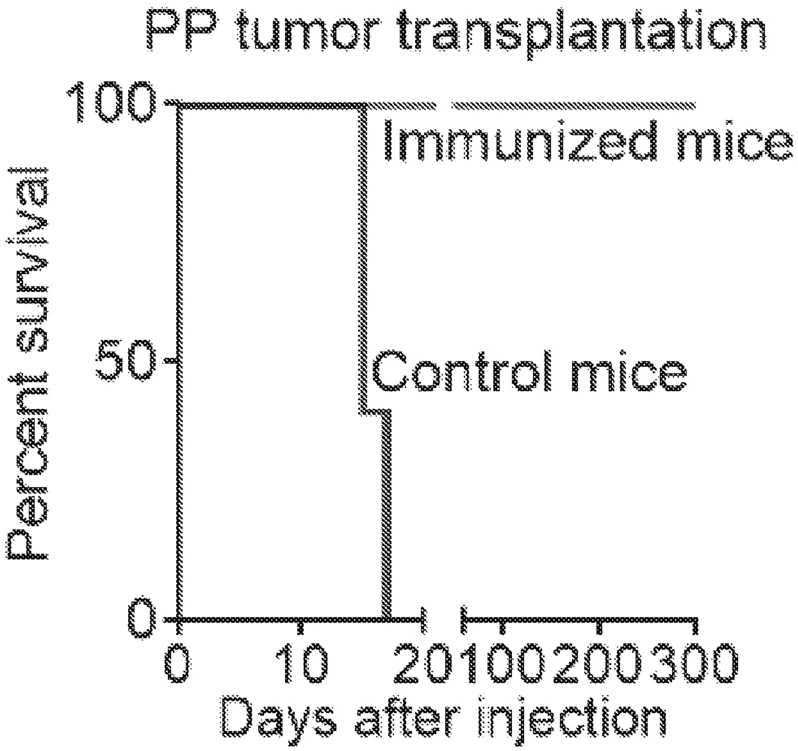
Figure 12F:
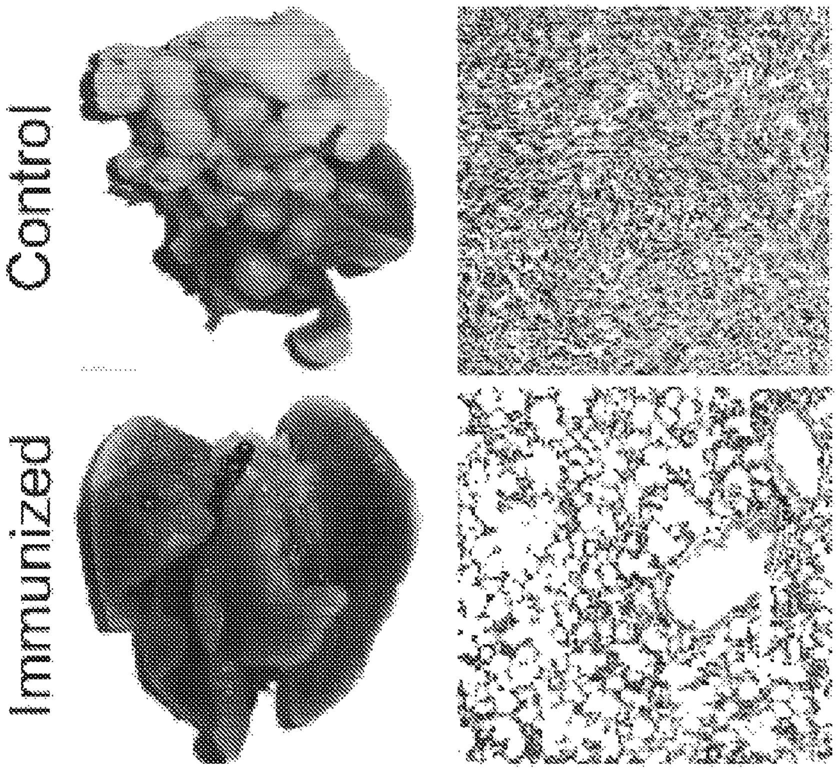
Figure 12G:
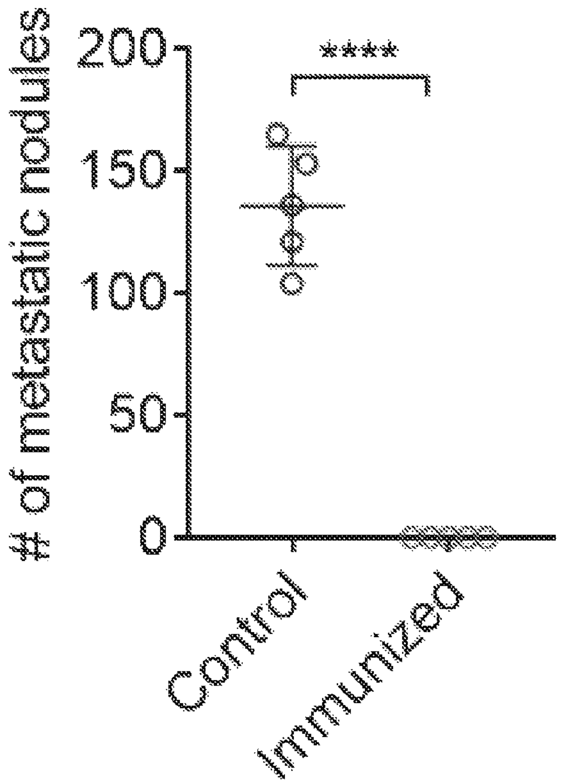

It was next determined whether $PP_T$ cells can prevent the growth of parental PP cells in the primary site as well as in a distal tissue, i.e., the lung. Remarkably, PP tumor cells or tumor fragments were entirely rejected when they were introduced into the mammary fat pads of FVB mice that had been previously immunized with $PP_T$ cells (FIGS. 12A-12E). In addition, PP cells were introduced into $PP_T$-immunized mice via tail vein injection to mimic metastatic tumor cells in the circulation. While control mice developed substantial metastatic burden in the lungs when analyzed four weeks after injection, $PP_T$-immunized mice were completely clear of tumor lesions (FIGS. 12F and 12G).

Figure 13A:
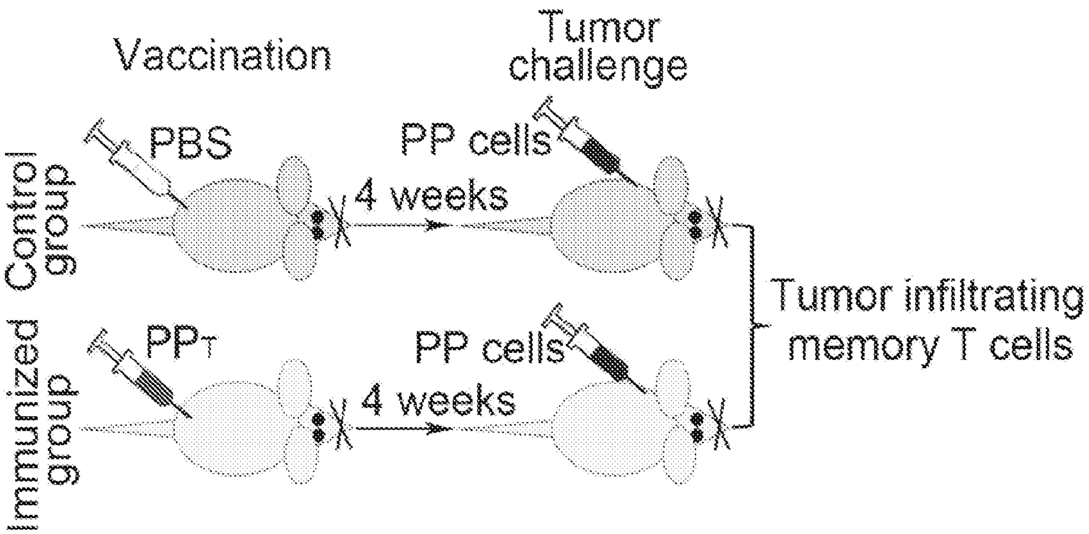
FIG. 13A-FIG. 13D show that PP tumor challenge induces memory T cell responses in the tumor microenvironment (TME) in $PP_T$ immunized mice.
Figure 13B:
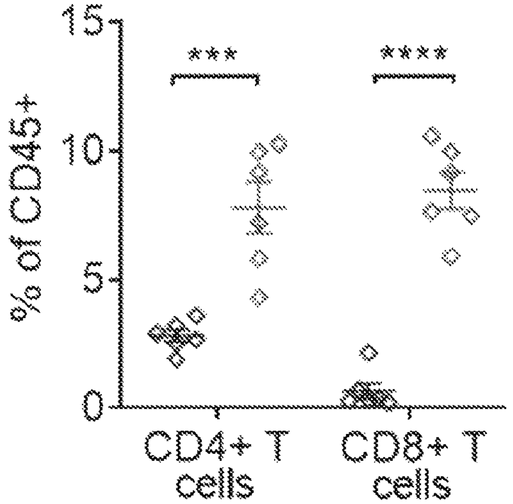
Figure 13C:
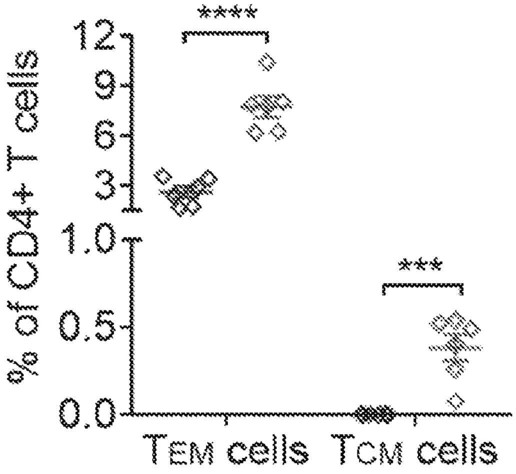
Figure 13D:
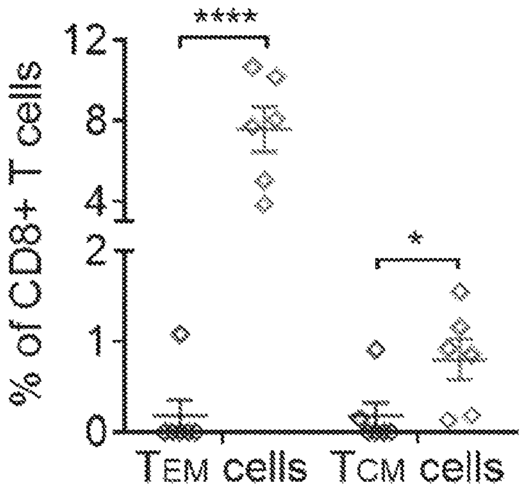

It was further shown that the tumor infiltrating CD4+ and CD8+ T cells were significantly increased in the PP tumor cells injection sites in mice immunized with $PP_T$ cells (FIGS. 13A and 13B). Both the CD4+ and CD8+ effector memory T cells as well as central memory T cells were also substantially increased in these sites in immunized mice (FIGS. 13C and 13D).

Figure 14A:
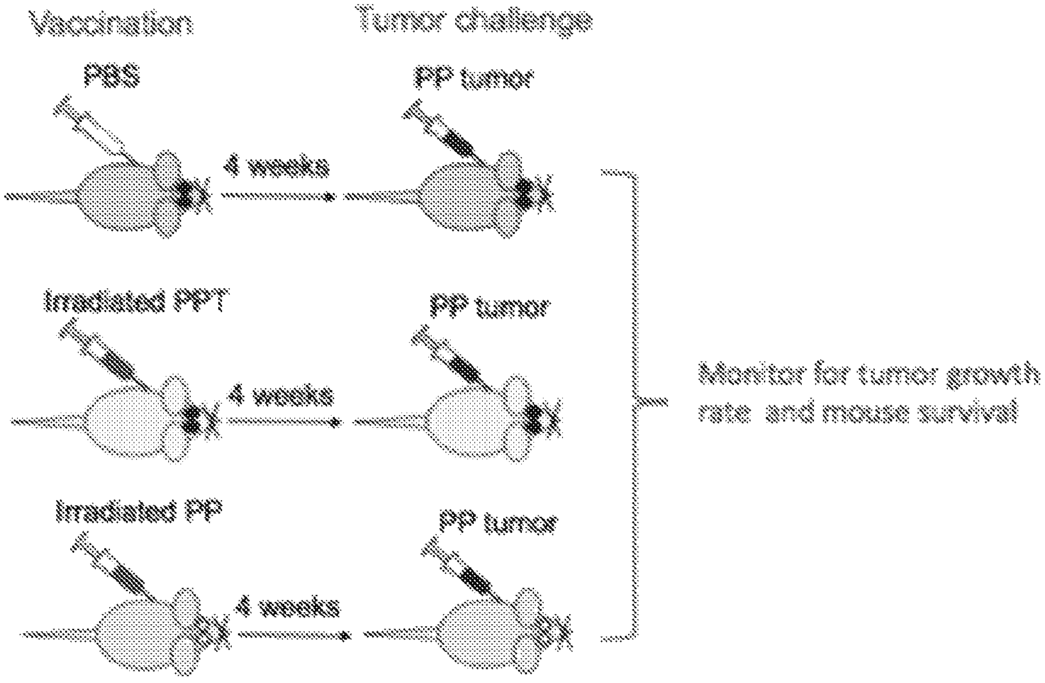
FIG. 14A-FIG. 14C show that the vaccine effects of $PP_T$ cells were not dampened by irradiation. Mice were immunized with 100 Gy gamma ray irradiated PBS, PP or $PP_T$ cells. 4 weeks after vaccination, PP tumor fragments were transplanted into the third fat pad of indicated mice. The growth of PP tumors (FIG. 14B, n=10 for each group) and survival of mice (FIG. 14C, n=5 per group) are shown.
Figure 14B:
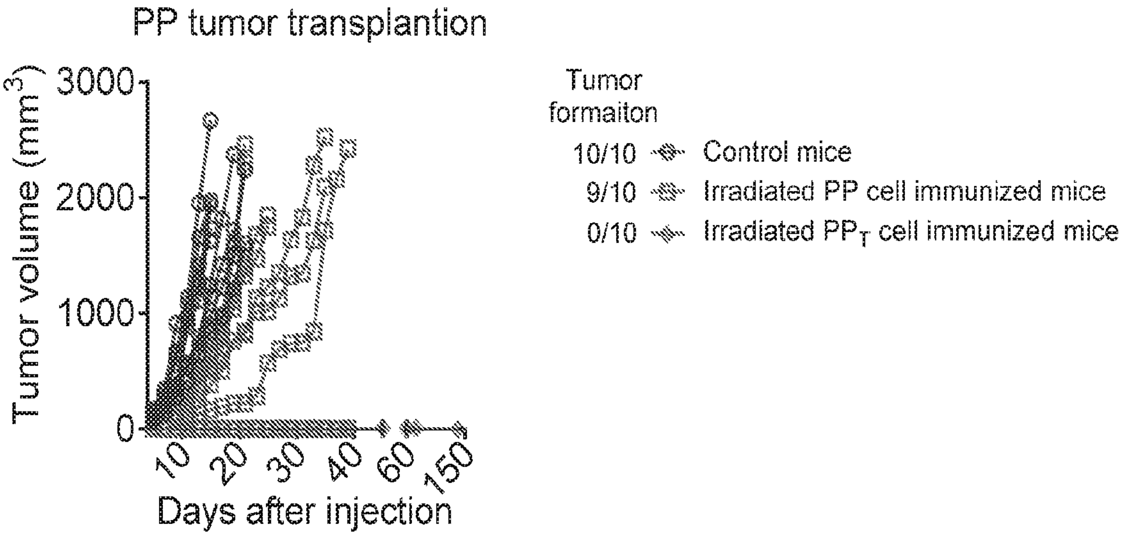
Figure 14C:
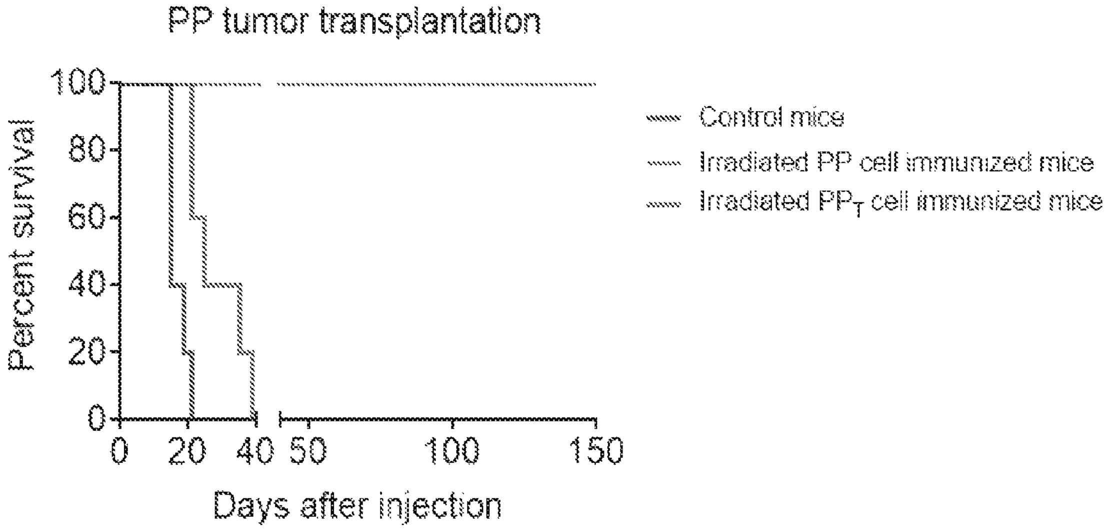

Example 8: The Vaccine Effect of $PP_T$ Cells was not Dampened by a Sub-Lethal Dose of Irradiation In order to prevent further cell division, $PP_T$ tumor cells were treated with a sub-lethal dose of irradiation (100 Gy), and it was determined whether irradiation can impair the potency of the vaccine effect of the $PP_T$ tumor cells. As shown in FIGS. 14A-14C, mice immunized with irradiated $PP_T$ cells were fully protected from tumor development when PP tumor fragments were transplanted (FIGS. 14A-14C). In contrast, PP tumor fragments were quickly grafted and grew in non-immunized mice (FIGS. 14A-14C). In parallel, PP tumor cells were also treated with the same dose of irradiation and injected them into one flank of mice, and 4 weeks later, these mice were transplanted with PP tumor fragments into the other side of flank. Irradiated PP tumor cells fail to grow in vivo, confirming that the irradiation prevented the further proliferation of PP tumor cells in vivo. Interestingly, pre-injection of irradiated PP tumor cells were able to delay the growth of transplanted PP tumor fragments and extend the survival, but, in a limited manner (FIGS. 14A-14C).

Figure 15A:
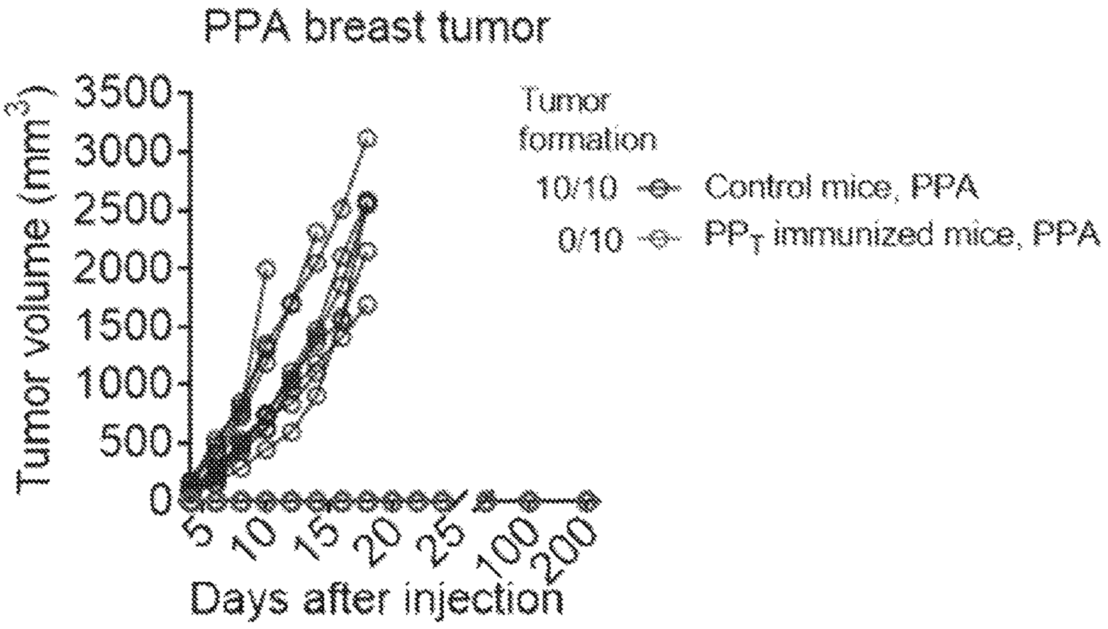
Figure 15B:
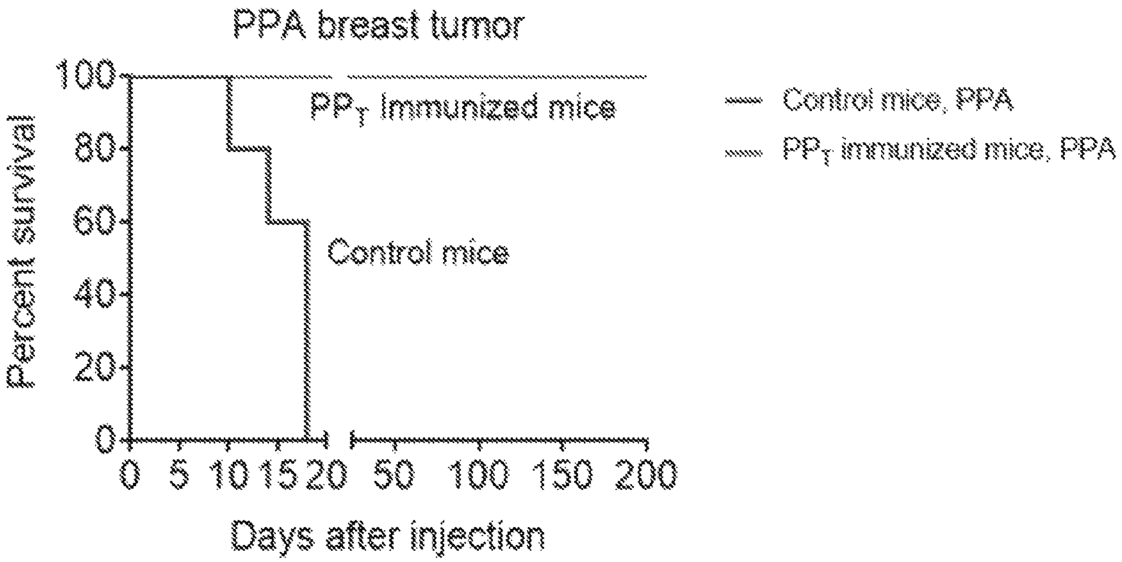
Figure 15C:
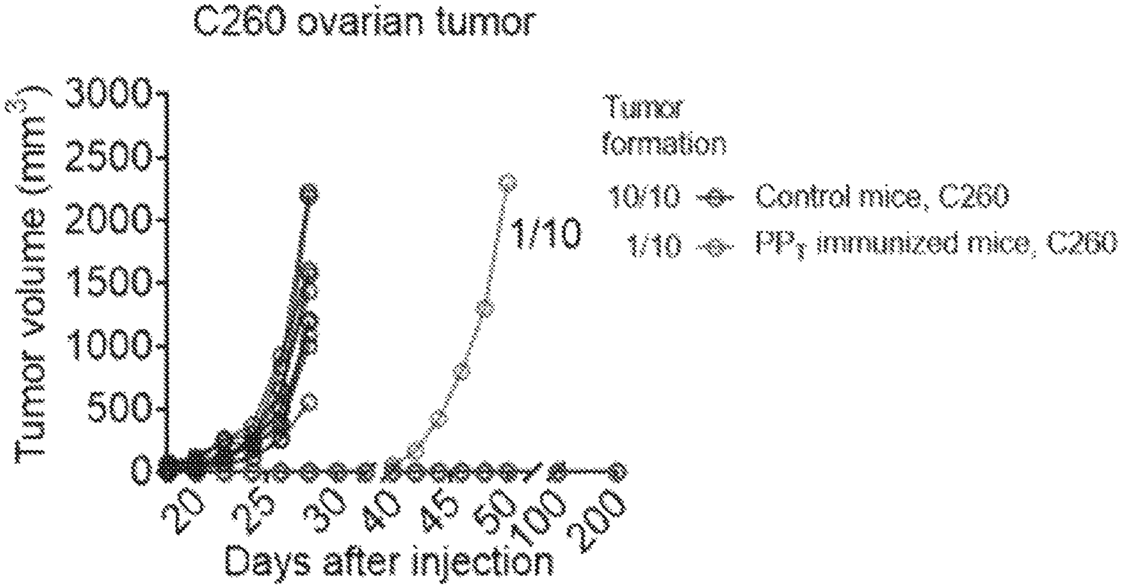
Figure 15D:
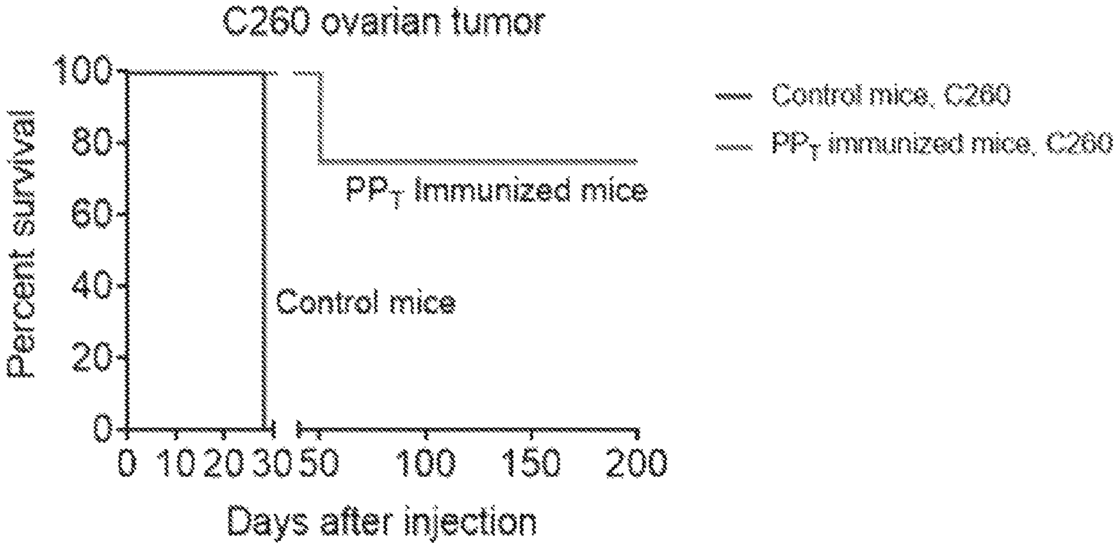
Figure 15E:
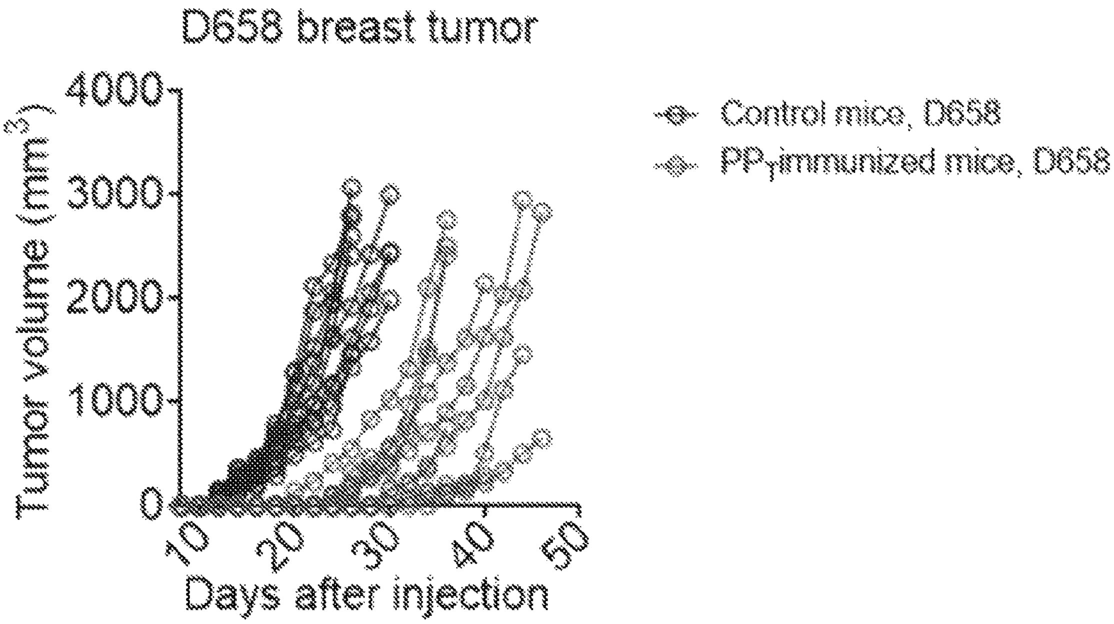
Figure 15F:
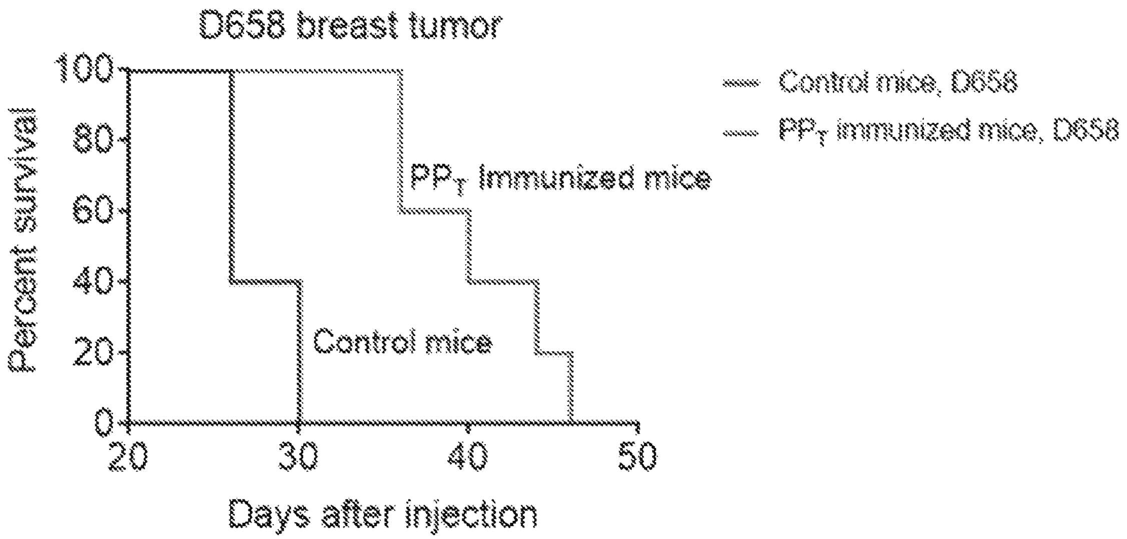
Figure 15G:
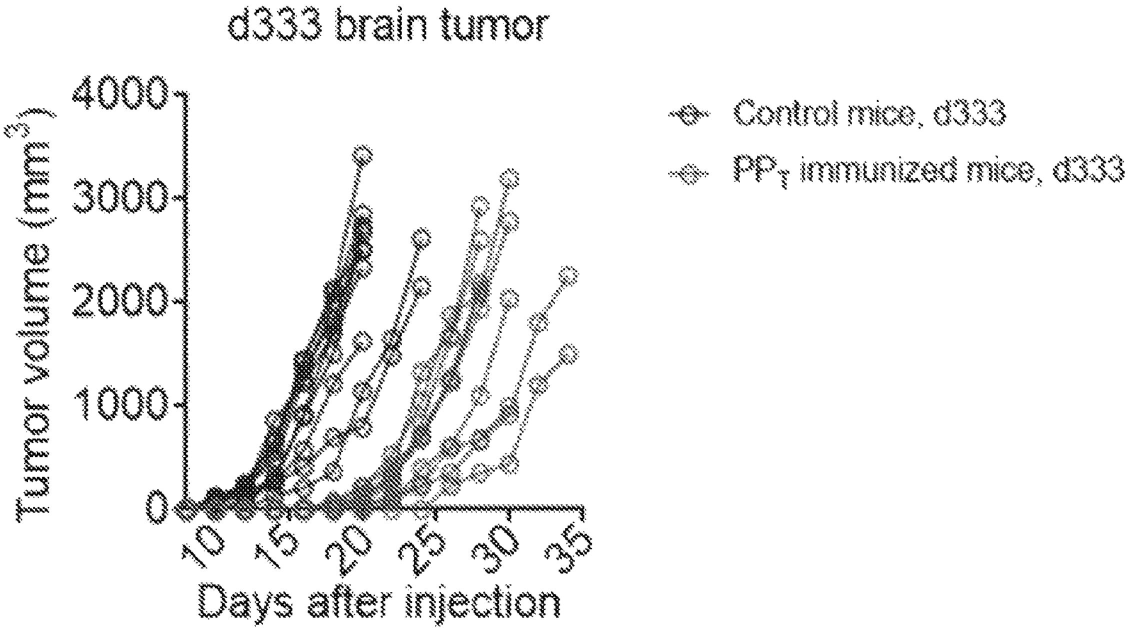
Figure 15H:
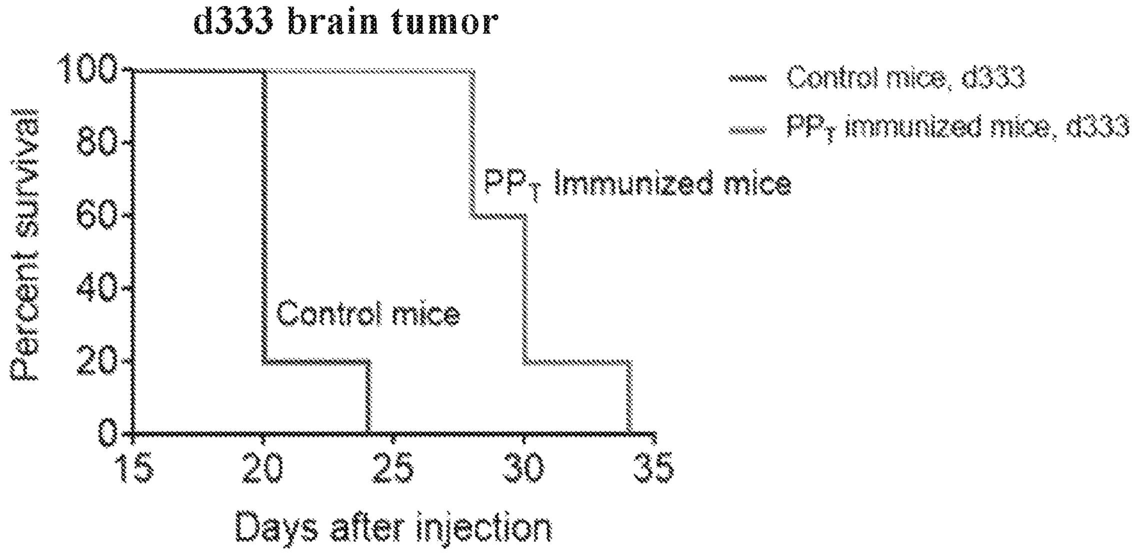
Figure 18:
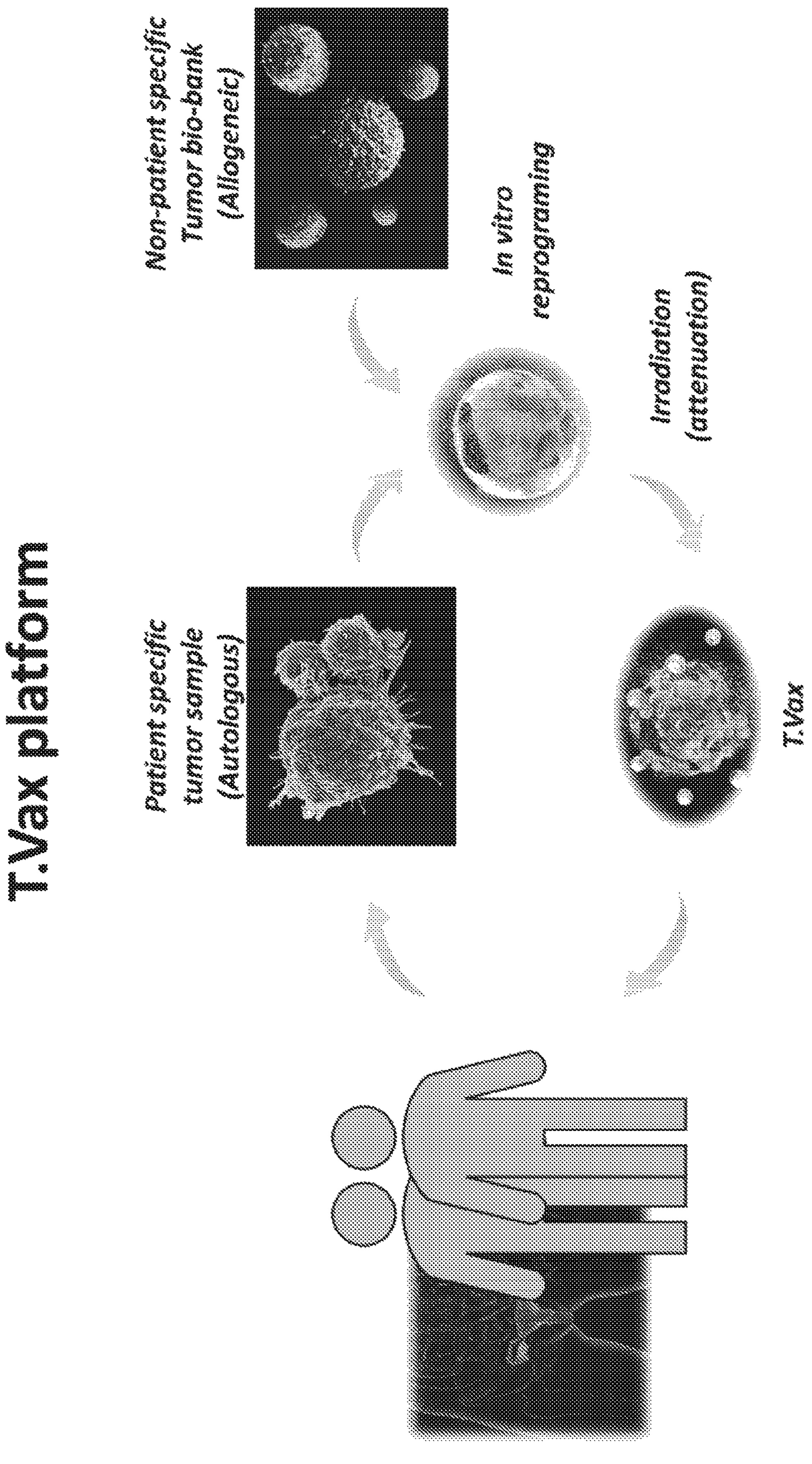
FIG. 18 shows a schematic diagram of a representative embodiment of a vaccine platform encompassed by the present invention.
Figure 19:
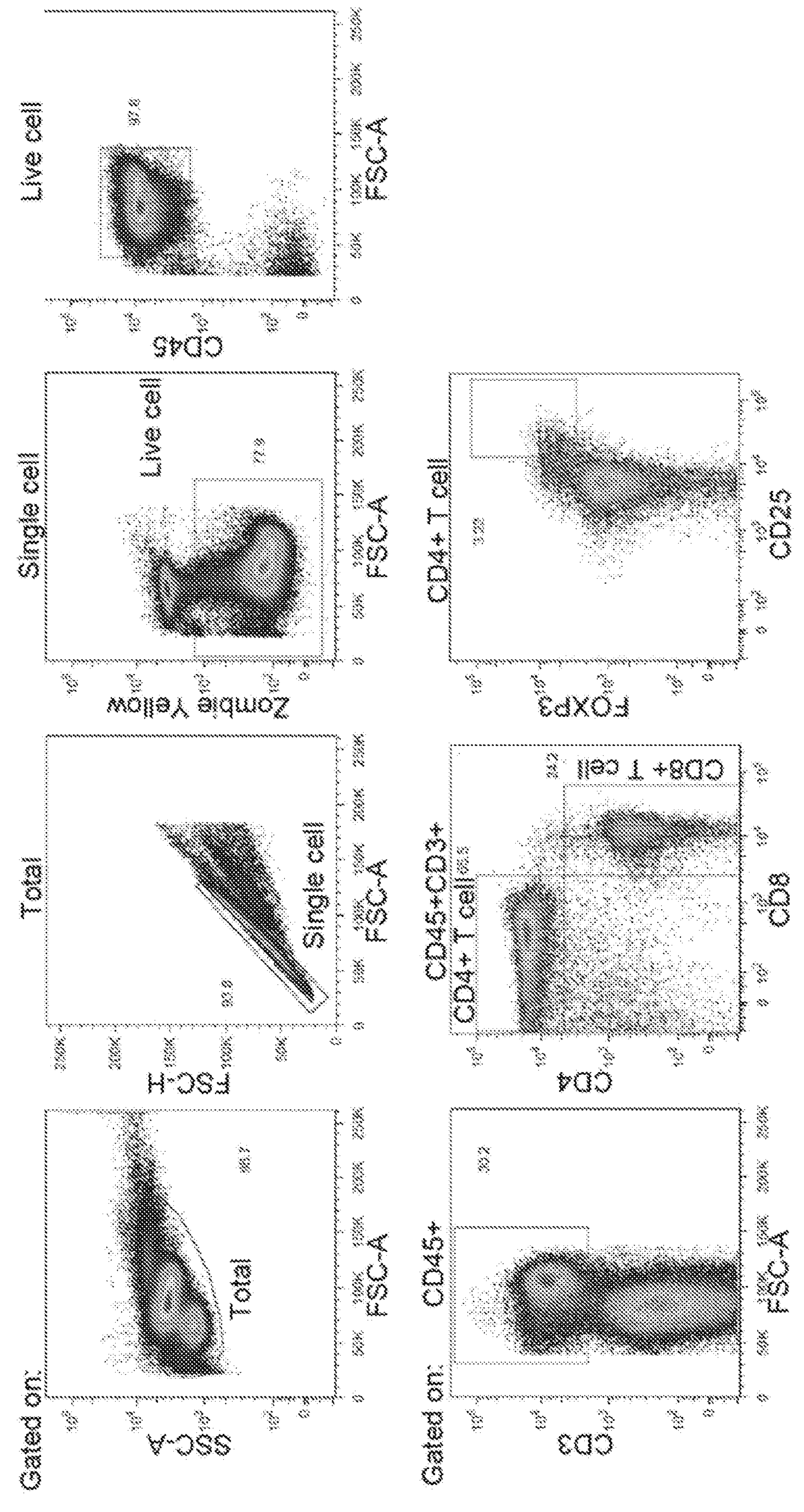
FIG. 19 shows gating strategy for T cell populations. Flow cytometry gating for CD4+, CD8+, and CD4+ regulatory T cell in spleen, lymph node, blood, and tumors was shown. Representative plots from splenocytes were shown.
Figure 20:
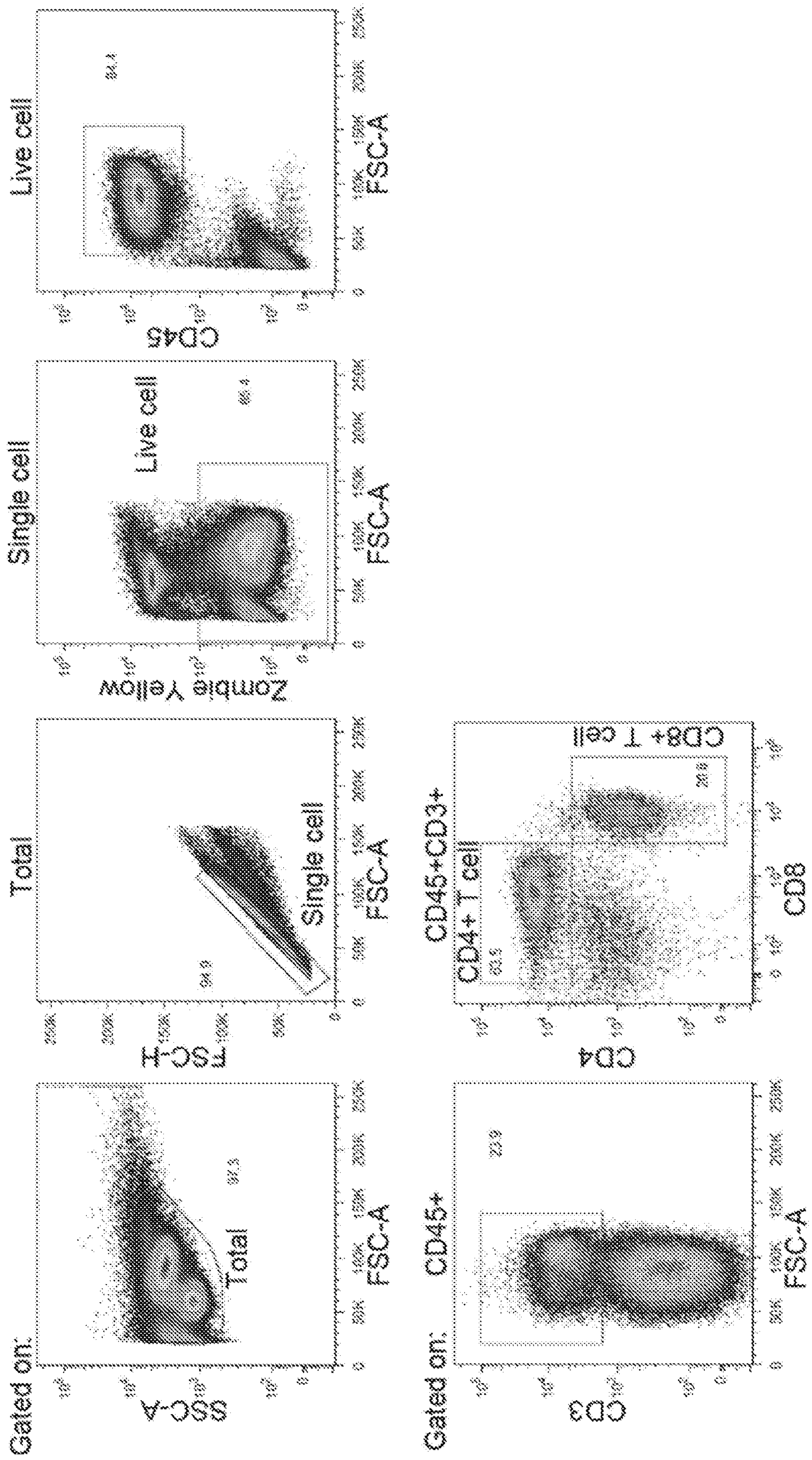
FIG. 20 shows gating strategy for Memory T cell populations. Flow cytometry gating for CD4+ central memory T cell (CD4+ $T_{CM}$), CD4+ effector memory T cell (CD4+ $T_{EM}$), CD8+ central memory T cell (CD8+ $T_{CM}$), and CD8+ effector memory T cell (CD8+ $T_{EM}$) in spleen, lymph node, blood, and tumors was shown. Representative plots from splenocytes were shown.
Figure 20:
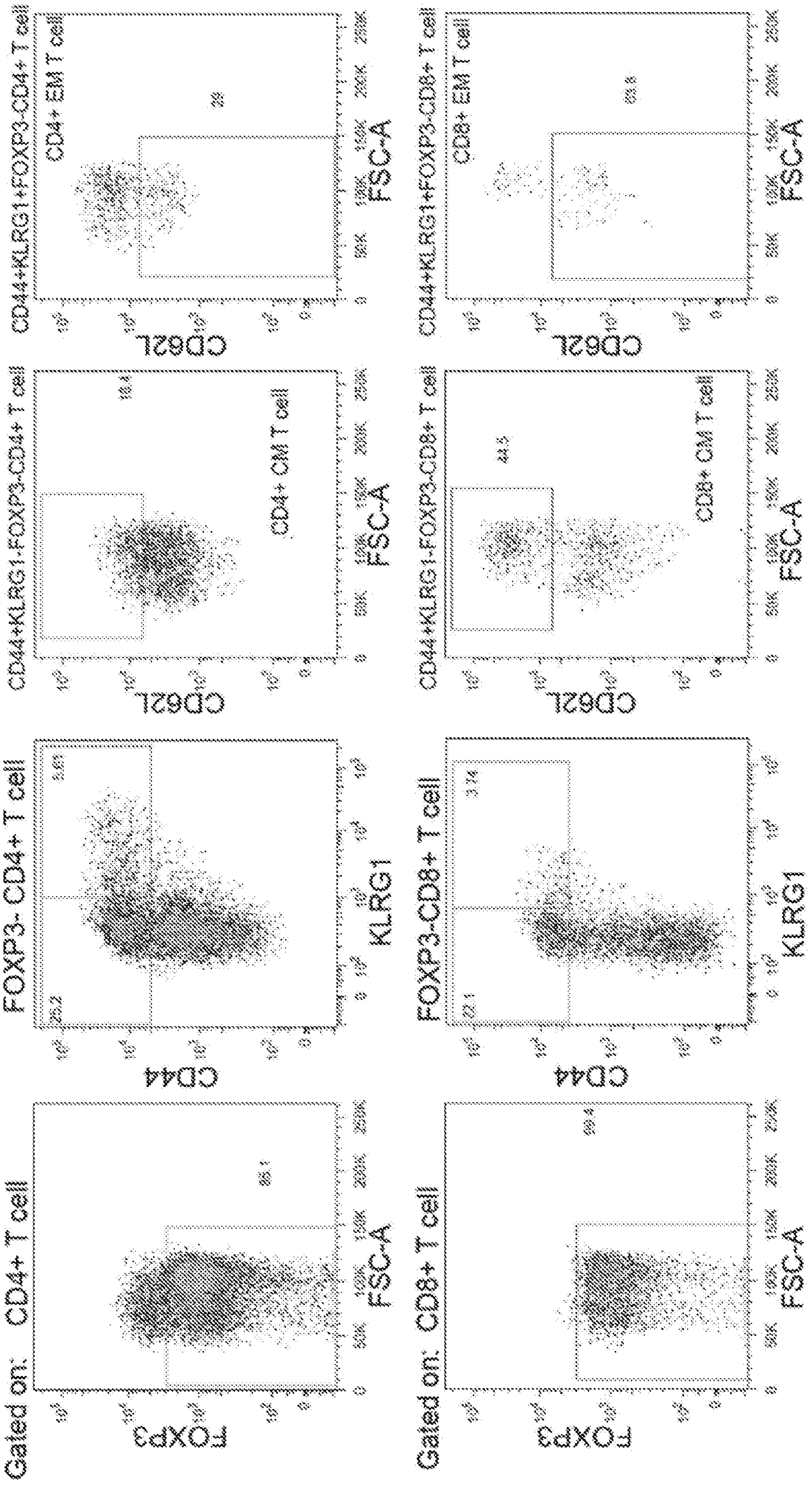

Example 9: $PP_T$ can be an Effective Allogeneic Vaccine Against Other Tumor Types The autologous tumor cell vaccines are greatly limited by the availability of tumor tissues. Therefore, it's also important to determine if $PP_T$ can also be used as an allogeneic tumor vaccine against other tumors with similar genetic background but different tumor types, or the same tumor type with different genetic mutations. The results showed that $PP_T$ vaccination completely rejected growth of PPA tumor (a very aggressive breast cancer cell characterized by triple loss of p53, PTEN, and p110alpha; FIGS. 15A and 15B). Notably, 9/10 of C260 tumor transplants (a high-grade serious ovarian cancer model driven by p53/PTEN co-loss and high Myc expression) were rejected in $PP_T$ immunized mice and 1/10 C260 eventual grew in a much delayed time (FIGS. 15C and 15D). Moreover, $PP_T$ vaccination significantly delayed the tumor latency of D658 (a Kras-mutated recurrent breast cancer cell model generated from a $PIK3CA^{H1047R}$ GEMM of breast cancer) and d333 (a glioblastoma tumor model derived from p53 and PTEN co-loss GEMM) and markedly extended the survivals of these mice (FIGS. 15E to 15H). The data indicated that $PP_T$ can be used not only as a highly effective allogeneic vaccine against other epithelial tumors with the same genetic changes, i.e., loss of p53 and PTEN, but also as a biologic which is active against different types of cancers with different cancer mutations. The data described herein support a tumor-cell based vaccine (T. Vax) platform (FIG. 18).

INCORPORATION BY REFERENCE

All publications, patents, and patent applications mentioned herein are hereby incorporated by reference in their entirety as if each individual publication, patent or patent application was specifically and individually indicated to be incorporated by reference. In case of conflict, the present application, including any definitions herein, will control.

Also incorporated by reference in their entirety are any polynucleotide and polypeptide sequences which reference an accession number correlating to an entry in a public database, such as those maintained by The Institute for Genomic Research (TIGR) on the world wide web at tigr.org and/or the National Center for Biotechnology Information (NCBI) on the World Wide Web at ncbi.nlm.nih.gov.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (310 sequences)

SEQ ID NO: 1 - DNA, 34400 bp, Homo sapiens
aggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttacataaaagattatcctatccccccgggagataaatttatactacttaatataaccccacaacaggcgcacaccacacactgcacagtgctatttatacatttttatttatttcagagtttgcctatgctacattagcgctctaatacataagatctatgctgtaaacaaaaacatcttcaaagttgaaatttgctgaaatatacttttaacaaaataacatttttaaggctccattgaaaaatactagataagatataatctcatataatcagtatgaataattttaaaaatgagaaatatttaggtcagccacacttcctttgtgccttgcaagaattcagttctgtggatgaatcagtactggttagcagactgttttctgcaaaccattttaaacatgctttagtatgcaacaaaaagggacctcaaatgctaaaatacactattttacgtggcattgaatagccttgggactggtgtagttttatcaacacttttttattaggaagaaacccaagaaaatttactgtaattgctaccacctgccactgtataaataatctaaaagggacttcccaacattgaacaacaacattgagggctgactcgagatccttctacattgtcacctcagcctggctttgcctgtcactgcttagcttgaagtagtgacactgttctgtatcaggagatttttataatggccctagcatccataattccacatgttcatcaaatggctgaagagtatgagagaagtattaaggtctatgtttgggctgtctccccacttggcatattctgtttttccctcttcaaaatagattgaaagcctcttagtgcaggaagcaggcatcagtatcaaactgatgtcatccaatgtaattattttaagctccaggtttgtctaagtttgggtgaagaatgttcaggaacatgtttgcaacatacagttatccagcttaccctttgacagattcacccttctcatcaaaatagtaagcccaacctaaaaattataagtttacaaataaaggaatagaaaaacccaaaaagctaatttacacataaaaattatcttttgctgcaataaataggtatggaaatatttgtagaattggtttaactgattttgtaaaacaaatgtcatgctattttgccatagtgagacatgcagtaattcttaaaatcacattaatagaaggcaagaacattgaatcagacttagcagataacagattcagtgataaatgaacaatagactaagcatacttaggaagctacatgagaacagaatgtattactgtgctcccgtccaaactgcatgactttattggttatagaataaatggaatttgagatggggatttgccagtttttacagtctgtcttcaatagttttgttggctgcctctgcacctttctaaatgttatgtgaaaataaaattatttaagttctaaagtagtttaggaaagagatgtgatgacaggaaaaagaagttaacttctgaacagtttggtccaggaagaagatgggcagaatacagtaagcccagggttgaagaatacattcaatttggagagatggagaagacctttgaagaaggtcaaaatgagatcttggaacagaactctcacctgtgtgtctggatatacatgaaaactggacggtgttattgagctactgcttatatggtgagcagaaaattgataaccacaagcctggtaggttctgctatgaagcccacatataatcacaaggcctagatagcttggagttaaaagccaaggatagctgtatagtttgggttccatagtttgcagtgagattgtgcttctgagcagtcatttgggggcagtggttctgagattacaagccataacccagccaagaacgggctacctgtggaatgaggatgaggaagttgctacatataaaccctagtgtgtgtgtgtgtattaagtgaaacttagttaacttttttgctcacagccaaagatgattcatctagagaagccattggaattttagcagagttttgtatatatgtggatttttctaataagtagcaaatcagaggccttaaccactgcccaacagcgattctccattgagagtacgtatcttgaacttaagaaattcatttgctctgattttaaatcttgtaaagtttttcttcatgagaggtcttgcctctaaactatattgtggcagtatttgatcaaactacataagtaccatgtaaataagattttaatacaaatgatgactcacttctaaatggtttgccatttagaaatgtgctgctgtgagaaaaacgaattttttttttttttttttggagacagagtcttgctctgttgcccaggctggggtgcagtggggcgatctcggctcactgcagcctcgcctcctgggttcaagtgattctcctgccttagcctcctgagtagctgggattacaggcacacaccaccacgcccaactactttttgtatttttagtggagacagggtttcaccatgtttgccaggctggtcttgaactcctgacctcagatgatttgcctgcctcggcctcccaaagtgctggaattacaggcgtgagccatcatgcctggctgaaaagtgaaaatttaagccagcttaccacctggaataaaaatgttttataggaatgtctaggttgctcttttatattgaaaaaaaacttattagtgtctgttttacccaagaaccacaagctacttcatttcaacttttaaatcatgaataataacgtgttatcaccacatttaaaaatgtacatcgtcaatcacaaacacatattctaaggaattgaattttatagagataattgaatgctttcatctgtaaaagaattagtggcctgcaaaccactgtggattcttgctatgctttgaagttgtcagtgggggaatttgctgctgcaagttacttagacttgtaggcaaagggaaattcaaatttttaattctaaaatgaaaaccactgacaaaattttatactctgaaagtttggttgttagcttagtcattattttcctgttctttatcatttcggaattcagatgcttaaatttaacatacaaattatttgttggtaaaacataaaacataaaaagctacatttggtaaactaaattttaggattcaaagtctctaacaatttctatgtgacatgtcatacggtgcagtttttatttgccaaagtgtctacttcatactgcctatgcactgcttcccgtttttaatctctctaccccaacccccctataattaaataaacccctagaaaactgccttcttttagaatacctaattgattactttaaatattttttcagaatcaaaattacaaaagggagagatacctaagaatctggcttgtttatattctttaaaagatcgcatttgattgaaggtgggtgcatattttttatatccactctttccccatttgtatgtgaccattgtaaaagtggatgtgcttttttttttttgctgaggtctagagacaatgttttagagatacagaatgaaacatttatgggtaaaatacaatgggtaagacttgcttcaaaatagtatgtgacagaggaagtagatggaggtatgaatgaataggacattgatggttgtttgttgggattgggtaagggagctttgttgtattctatttccttttagataagtttgaaattccttgtagtgaagaaattaaacgtctccatcaggtgcattgccacgtcttctctaggaagcctccttaacatcctctggtggctcctgaactttttctgttctcattcacagggaagctcatggggctgcctggagacttgaggttacatcttgcctagtattaccaaaattgtgatacttttctccaccccataatagcacagtctttggtctcaacttgaactaaagtctttttttttttttttttttttttttttagtatttattgatcattcttgggtgtttctcggagagggggatgtggcagggtcataggacaatagtggagggaaggtcagcagataaacatgtgaacaagggtctctggttttcctaggcagaggaccctgcggccttctgcagtgtttgtgtccctgggtacttgagattaaggagtggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcctagtacagaacaaaatggagtctcctatgtctacttctttctacacagacacagcaacaatctgatctctctttcctttccccacatttcccccttttctattcgacaaaaccgccatcgtcatcatggcccgctctcaatgagctgttgggtacacctcccagacagggtggcggccgggcagaggggctcctcacttcccagacggggcggctgggcagaggcgcccccccacctcccggacggggtggatgctggccgggggctgccccccacctcccgaacggggcagctggccgggcgggggttgccccccacctcccggacggggcggctggccgagcaggggctgccccccacctccctcccagacggggcggctgctgggcggagacgctccttacttcccggacggggtggttgctgggcggaggggctcctcacttctcagacggggcggccgggcagagacgctcctcacctcccagacggggtggcggtcgggcagagacactcctcacatcccagacggggcggcggggcagaggcgctccccacatctcagacgatgggcggccgggaagaggcgctcctcacttcccagactgggcggccgggctgaggggctcctcacatcccagacgatgggcagccaggcagagatgctcctcacttcccagacggggtggcggccgggcagaggctgcaatctccgcactttgggaggccaaggcaggcggctgggaggtggaggttgtagcgagccgagatcgtgccactgcactccagcctgggcaacattgagcactgagtgagcgagactccatctgcaatcccagcacctcgggaggcccaggcgggcagatcatgcgcggtcaggagctggagaccagcctggccaacacggcgaaaccccgtctccaccaaaaaatacaaaaaccagtcaggcgtggcggcgcgcgtctgcaatcccaggcactcggcaggctgaggcaggagaatcaggcagggaggttgcagtgagccgagatggcggcagtacagtccagccttggctcggcatcagagggagacggtggaaagtgggagaccgtagaaagtgggagacggggggagacgggagagggagagggatgtgctttttttctaaccgttattgccaccaagtaataatgtcttaattcacaatttacatagtgattggctggagagaggtattgagcataaatttttttttaagattcaactgggaaatggatgatttacatgattttagtctctttagttgtctgggtatttcttgactgggaatagcaatatcttaaaggccatttttaacaagaatgctaaggatggaacacttgaaggaagcagtcctgtacagtcaaatacttcagttaccttggataatagaatgaaaactcaattgcctactttgaacaaattttttttttggattttaatggctggacagaataacattctgctaattttaatccttggtcatttccgatgtaatggaaaatgcagtttgactcagaatcggaggcctggggtttggaccctgattgtgccaatttatgtgactttagataaatcttttcatcagtctaccttaaagttcttcatttcctccagttccctaaaatgaggaagttagtttttagggtggttatgagaactaaatgagagcacttgagagatcattcagcctgaagtgggtactcagtattagatggctaaatctgcacagtctagaataccaggcaaaggttactctgaaggtctttgctaataacaaatctttctctaagaaagtttgtaaatgtgatgttaaactcagaaatgtcacatagaacatattggagcaattattgccgcaaaagtaactcgtagcaaccacaaaaacccagtggtgtgcagcaataaacagtttatgaattagataagtgatttcggctagatgtctctggagcagttgtagtctttcctcgttcatgagggagttggcctcacctggaaggacttggcatttttccacatgcctcctatcctccattaaacaagcatgtttttgtggaggttgtagaaggcaacaacagccaagcccaatcccataactccctttcatgtctgcatgcttcatgctaactagcattcaccagaaacaagccacatggctaaacccagtgtggaaaggcactacagagttattagaccaagggagagaacataggaggggtgaagaattggagccttaaatgcagtcaatctaccacacccttgctttgtatttaacaggttactgtactggtttgccagcaaacaatggaaaatgtggagaagctgaagaatgctcaagctgggacttaatagagtggcctatttggtttgaaatgttttaacttacagagcattgagtagaagcctaatctaatatacataaggaagacaaaagcaaaggattgtgttttctatctaaaggttaatcattgtggttgctcctggccattatcacatgactggaagttaacactctccaaacgctgagcctatcctgtacagcactagaaagtagaaagaatcactcaattcagggaaaccgttttctcttaatgtgaacatttacattaatgccatttccaaaacctttctgggacttcttaaatgcaaagatgctatctgctttacttcatgctgcctgtttttaggagcttggagtgctttaggaagcttcccaatactggtttagcagtaatttggttgactgatcaaggcatgttttaactttgacactgaaattttaaaaagacaacagttatcttgcccggagagtcaagtttctgcttccaaggaggtcaggaattgttctctttggtgatgtggctgtgcttggtagcccttgaaagtggagtcgacagcagtcctcagcttttgtgtgcctgtcttagtctgttttgtgttactataacaggatagctgaggcagggtcacttatgaaggatgctcacagttctacaggctgggaagttcaagggcatggccctggcttttggcaagggctttgctgctgcttcatagcttgatggagaaggtcagaggggaagcagacgtgcaaacaacccacttgttcacaacaaccaaacaagtctctttttaacaacccactcctggggactaatctagtcttgagagagtgagaactcattgcaagagcagcaccaagccattcatgaagcatctgcctcagtgaaccaaacatctcccactaggccccagctctcaacaccaccacaatgaagataaaatctcatcatacatttgagggacagtttgggagacagaccatagcagtgctcagtatttctacccaaatgttcaggtaacttaatatatttttccttgaatatatgtttaaatgggcttcccttccccacgctcatcttgaatggtcccacaacaacttttgattatcacgttcctgtaaatacacaaaaatattttgtggtcttttactggcagcccagtggatgggactttaaaaaatcacccagattccaacaaccagagaaaacgactggtgtatattttttccagtctttatttgtatgtctgtgtatattcaatggaaaatgtttgaagcttcactcacagcacattccattagagaaagctactaaaatcataaggaaaatctaaaatgcagtaagccagtcagcaagccataatgggcatatgaaaacaaagttttttgccatgatttgtggaccacagaagatctgtgttattagtctatttaagtttggtgtttgaaattaaaaatgttcgacatactttttatgttttttttaaatatactgtctatatttaaaattgagtatactgtactttagtgtgtttggaagcagatatccccaaataaaagtatacagtagaaccaaagaattttattgatcagctagaatttagttttcaggtgtaataactgtcaacctaaataacagaggctttctaaaagaaaatgatgtttatttgggaatagggcattgtgaaggcaatatgcatgccatagtaaactgtgtgtattcaggaaggtaaaggaagacaggtttttaaaggacagataaagattatataattgtcttgaaataattattcttggctacaaggattaataacaaggatgctgccagttcgggtttggacaatcggcttctaggcagatgtcccaaaagtattttctgtgtaaggttgcgaatagtgtttgtgcaagctggcgtggtttcttctgggtctttgaggtagtgcgtaaaatccctctcttcatggacttccctggctccatttgtcagggcttttggaaacatgactcttgattctgacagctttcacctttccctctcttgatgaagatgtttttccgaaagtatctatgatgaatcatcttgtagttaggctttgattgtcccttggtgacagaatagacctttcccgggttattggtctggtcctgcatcctgcattggcaggagtgattggcaactaaaagtcagtgttaaaacccttttagccacctttgagggcagggaggctttaagggagtggcacttaggctaagtccacctggagtctattattaagtccaattttttttccttagtcctttgttgtcccctcaaagtgctgggctagcattattctgttaggaattgtacttctttctgcagaaaatttggcaaataacagatacaaagtttaaaaaggaaatacacaaaattaatagtaatgtgacaatcccagtttgcataatggttttgagccctgaacctaggcttacaggcaaccaattgaataaatcaaattgtaatacaattcttgctctgatgtcttaggaaaaatgtctacagcctgaaatcatcaactttttgtcctggtttgcagtttgaatgtctctagctatggcattggttggtatggtgaacttttgtgtgacccatacatcagcatgagacttgctcctttaaaaattaatcacatcttagcttataggcctcagagcatgggagtagttttttttcttagagagtcatagccaaatattgaaggaaattaggaggattcaggagcaaatccagtctgcaggtggataacaggagtttcaaaacggtacagagctgtgatctaataacaggtacatatagctttcttcagaaacttaaagttaccctgatttttaccaaagatgttcagaataaaacagatttgtaaactttatcagattttgtctgcaagaatagtagtatggtcacagtaatctcagatttaaaaacctccttgaggctaagaagctaagtcaaggtagactttagattttacctatagttttaaggttcctgggcctgccaggaaatgataatttttaattcagtgtaatgctgagaaccattgaagccaggcattctacacattctcaaatatgacattttaatcaaagccttggtaatacaaccagtgtttccaattgtatcctgttataacgagagccgatttttattgaacttaggcaaatcatattgccttaagagtactcacaaataggctgggcacagtggctcatgcctgtaatcccagctctttgggaggccaagacaggtggaacacctgaggtcaggagtttgaaaccagcctggccaacatagtgaaacctccccccggccaccgtctctactaaaaaatacaaaaattagctgggtgtggtggtgcatgcctgtagtcccagctacttgggaggctgagacagaattgcttgaaccctggaggcagaagttgcactgaaacaagatcgtgccactgcattccagctggggcaacagagcgagactccgtctcaaaaacaaaaacaaatgaatactcaaaatagtttccaaattggagggatcaagaagaaaggaaaagcaaatatttctacctttgttcacaaaagtattccaaattgctgtaaactatagatagcatgagagaatttctttaaatatggaaaacaaaacatttaagtaaaaaaacaataatgcttcaaataaaagtcacagacacatcttcagttacttagtctcatgtaactttttttgttgtggttgatcttaattagtagttacatggactcatcagtttcttgaagttctgaaaaaatatttagtccattggtattaaagtgattagtaacctgtatttaaaagtgtgttagcatcttttccatgaatctgattgcaaatgcttttagagaaaaagcaataactgggaattacaaaaacttagaataaccatgattaaaaatctgatgagagtttaccataaccagaaatagacaaagagttttggttatttttgtggcaaacagcataatcagaattatgactgatgacatatttctaacggcatcgtacaattttggaacactcatatcaataacatactcataaatgtaactgtgtctagtattacatcattagacaatgcttttcatacaatttaatacatcaaagaagcctaattagctaacatctctaccagatggcatacacatgctctgaggctttccagaggcccaagtggaaaactcaaaggtaattttaagtcaaaaacacttaatttagaacttgagcctagagaagcctgtcaaagatgtcaaaagttcgaaacaggatcacaggtcactataaaatatttaacaagaatgataatcaaaagacttaagaagcaatgcagaaagttacatacatttaaaaaccatcttttcaaagcttcatttttcccaagcaaaaaaaaaacttaaacacaagaatttatcttgatagaacataaaatttttcttaggccagttgccaaaatggtaaagaaaaatctcttgcagtgtgactgcctttacttatgggaagcctatttggatatactgaaagttgaatctgatgaaaaggtacttgaatttaatcagacacaggaagagtatttccaaggttatgagtgtacgccttatagaggaatgtaaataagaaagctagtatgttgaacagaatacatggctcttggaaaaattacgagaaatttcctgcttgcgtggaacaattcaaacatgagaagagccaagaattcagaatcaagttatactggaggaaaacattgcttttctaggccttctacagaacatttcagtatcaagttataacagcaagagttagaaccagaggaaaaaagttacaggagctaatgaaaaagttaagagttatcacccctgccaaacaaaaagatgtaccttcttaaggggagaaagagctaaaggcaatgatgtgtgacctacaaataaggtgcagcaagatacagcaaaggttgaacttgtgagatataaatcaggatcttcaagaagaaaactctacctcaagaaatgaaatgaccatcttaaatgaaaaaagacagcctttctaacctgaatctaggggaaattaaacggatctcagaaggaaatatggcagaaatttaaactgtggtttagaagatggctgattttagaattaaaaattaaaacctctttcaattttattaagaccagatccttaaaaagaaccttgttctaacattggggaccaaattttgtgtgtgtgtgtgtgtgtgtgtgtgtgtgtgtgtgtgtgtgtgtatagtgcatgtatagcatttacactatcgtgtatatacaaatatatagcatatgtatagaatatactgtattattgtacatatacatatgtacaagtatatatgtaagctcaatgtcttatgatttcattctgacctattgccaacttcattacacacaactcctttcataaatgtatccttcatgaacatttcatgatctgcacagaccttcagtgacatgcttaaactttctgctttgttttatacttccccttaaacaactggtcatcctgctttaggataaaaagttactatgcaagactcatacagaattattctgttaattttgtaaccttccttaccaaaggtacattctcacacccattaacttccttcatatttctctcctcctcctacttagtggttcctttctgtcttgtttccatatttgaaacaacctctaataaactctgaatttaaacaacttttttcccaataaaaagcaatttttatgccttataacttttctcatcaaaacatctttttttgggtacactttgtatatggaattgtgtattttcaaattttaacttattaaccttaatttttagtgaaaacctaggaagcaaaattttgaagtgttatatcagcattttataaatgagaaccatattataatttttagaaacatgtttccttataactttgtatattaataggcccaaatatatttagtctttctataatttaggaagccaagaacaaactaatattttcagcagtttattgtttttttttggaaatgatccagacatttactgaagattaatttataagatttcaaattacatgaaaagttcattaacatcctatttttaaaaacattcttttggtttattttttagagacaatgtcttgctgtgttacccaggctggagttcagtggctgttcacaggcacaattgtagcacactgcagcctcaaactccaactcacacaatcctcctgcctccgtttcctgagtagctggaactatagatgcatacctgcataccaccatgtctcacccttgcttatcccgtttataatccatccaattcttttttttttttttttttttgagacggagtctcgctctgtcacccaggctggagtgcagtggcgtgatctcggctcactgcaagctccgccttctgggttcatgccattctcctgcctcagcctcccgagtagctgggactacaggcgcccgccaccgcgcccagccaattttttgtatttttagtagagacgaggtttcaccgtgatctcgatctcctgacctcgtgatctgcccgccttggcctcccaaagtgctaggattacaggcgtgagccactgcacctggcccccaattcatttttaacaattattcctagattacttataaaaactgagatattagacatagctagtcatttcaagttattttcctgttaaccatttttattacctgtgagtatcatgtgttcaattaagaaccataaaaatgaaatatgtaggtattttgccagtaactcagaggacacagctgaagtcaataatacaaaattagttcaacttacagttatacaaagatcattctgtttttaagttgagtttatagttttatgaccttaaaaagtctaacagagacaaatataaaactgagtagtaaattcaggcaaaaattttaaagacacttatttttgatttaccaattattttaaaaccagcttatcagatgtttaagttatattaactaaaaggcacttgtgttaattactatatattttgtattagcactcatttatttgatgaatagaattccttaagggatttgtggccaactgccagattttaccacgtagacacaacatacaacatatatatacatatgtgtaaacacacctaaacatacacatacacaaacatagctttcattttagaattttagtcatacgatagtaatacaggcttgctggtttataaaagacagttattggattcaaattatatttctgagaaagtgggacctgctcagctgggtaaacatgcagaataggtaatcttatgaaagctgtgaaccaaaagttttggtaaatagcagtttggatttttaaaaaacctcttaccccacctccccaaccccttttttcccttttttcagtttcaaatgagtttaatgttaatatttaaatgcttacatttttagctaggactggctgaattgtataagaaaaaacaatctccaggtggccttgaatttttagtaacaaatcttttgtttgccattctggtttttttgactagtcagtgcaggcagggaagcattttagcagttgtggatgaggggtttttgttttgttcttttagcctttgcatagcaggcaagcaatttttatgctataccagagataccttatattattgccctgagctcaagattttgacctgtttgagagcctaatttttatacgtatttatctagttcttttaggctattaatcctttaattaactgttccatcaccctaagcagttattaggcaaacctaaatttacattaaaagggatacttcttaattctaggtgttggttgccagggaactattataatttataaagccattaatttaaggccctttaagacctttttttttctttttgttcttggctggaatgccgtaaggagtgagtttcatctcaacactggcagaaacagcagatttaaagtaggcagaaaaaaaattagagagcttagaagactctacatatcaactctatagctgcagtctcttggtactaagaataaaaaagcttggggagtttagacaaagcatagacaatctctatgatggtcattgatccaaaaacatgcatgaggaaaagccacatagctgacctgaagtcccagaaaagcaggcatgccttaatgtttgagaatttccattttgtttcttctcaatctcttaagagcaaagaaaattctgtaaatcctgacagataagtcaggtgtttggaccagtgttttaactggtggcgattgccctagtggctttaaaagagccatcctgtgcccaaaatttagaatgtttatttttgctcttgggagatgttcagaaacaggggaaaagagccaaatcatttacagatgcatgtaaccatatcgaaacgaaaccaaaatcagtgttcccaaaagtgttaacccagtcatgcagattaaaaaataatataaacacagaagaacccaaagtaaatttaccagaaaaggcatgcctcagaatccagagtactcagccaggcgcagtggcccatgcctgtaatcccagcactttgggaggccaaggcaggaggatcgcttgagcccatgagttcaagaccagcctcagcagtatagtgagacactgtctctaaaaaaaaattgtttttaaatccagagtactcaaaccagagggacacttgtctttatatcaaaaaggacttgccaggaaagacaaaaagtcttttgtcatcccaggagggatgtaaagtcctttattaaagtggtcttagaaccaagacaaatccaaagtcaagtcaaaaagcctctgccaaaagtgggaggctctgcctgagaaaagactcactggggcagaacagacaagctatgtaagcggagagcccaaagggctcctgtgagtactgcatactgattctgagatcaccacttctctctgaaatgtgtcctacttcaggttctactgctgaacaccatttatgtcaacacagagagaggctctctaaaagaaaactctatttgggaatacagcattgctgtagaaatacgcatgtcatgggccgtgcgcggtggcttatgcctgtaatcccagcactttgggaggctgaggtgggccgatcacgaggtcaggagtttgagaccagcctggccaacatagtgaaaccccctctctactaaaaatacaaaaaattagatgggtgtattggtgggtgcctatgatcccgctacttgggaggctgaggcagaagattggcttgaacctgagaagtggaggttgcagtgagcctagatgtgccactgcactccagcctgggcgacagtgcaaaactacgtctccaaaaaaaaaaaaaaaagacccatgtcatggtaaactacgtgtgtattcagggaagtaaaggaagacaaagattttaaagaaaaatgagggttgtataattgttttgaaataattgtcgttggttacaaagatcaatagcaagggtggtgccactctgaagttggacaggcagtggctaggcaaaagtattttgtgggtaacctttgtgaaaggttgcagtttttgtaacacaagctgctttattttcccaaaagctttcacagtacatagaaaatatattggacgtgtattaaatgtgccaaattagtcagcaatattacattaaaatatgtgttattacttgttaatgttcttaataagttgttcaggcagttataccagactatcttttctcattttccaatttataagtgtattatccaaaaatgttagttttagggtgaccactgtatattttggtattttttaaagctacccaattgtgtataatttataaaaatctttttttcataagacctaaaacttctgaacaatacataggtgcaaataaataaattcctttttatctcaaactcacttccactgccctccctgaagaaagccttttgttattgttgtcttgactaaatgtggcatgggagctaacattttcaagggaagctgatcttatctccgggctctagaagccaagacatgaggtatgtgtttaccgtctcttaggtgactctccagaactttcattctcaacctcctccctcactgccagttcctcctcagcttcttagccaagtggtagaggaaaaatggtattttatgtcaggactaagccatgtgctctgagccctgggtaagtctgcaaggcttctctagaactcatacataggtcaattattcctcctctgaaaacttaaactctggcaccactagctttttcctacagcatacatgggctcagtaaatcctctgttaagacaacaggaaaattaagacaatgtccttgcaagccccataactactttctatccctgctattcacagccaagtgtgtcgagaccagttcacacaaaccttgttgattttcggtttcaccccctccttactaaatcacccctccatttgctgcagttgcccttgcgtgctgtactcagacttggaggaagtgatgtcttattcaaggccagtttttgtactagtggttaaataaatggtttccaaattggagtcagaaggagagcttctaaaatgtaggttccctggcctcaattgtgagattctgctttagcaggtctggaattggagcactgggatctgcattttcagaaaacccaaaatgattatcagccaggacttaaacctctgctttagaccacattccctgtgggctttcagattttctatcaatgttcttccctcttcccagctcccacacattaaaactcagatcatgcagaaaagaagttacagttccttcatttcacatcaatttctcatgcatcccatctggttttgggaaggtgtgggacgaggtggatggccttaaacttgccaatcaaagataacgttctctttcgattcaaatagcctatctcaggcttaaaaccatctctttggataaatgctcagcttttcaaaggttcttcctagcttcttcctcatgatggcatctagtgggtgagaacagtcatctccaggtgacacaggaaagagtttctctaatgtatgtgctgaggtccttgacggtcctgctgctggtgctcatcctgccatctttgctggatgtcactgagtctactgggtaatgtaagtgggtccctggcttttgttcactgctgtcatgccctgctcctgaccacaactctgtcattgcctttggtctcaaggtctctaccttaatagcttccatgtcccaactatgggactgttaatctgctgggctttggagtgggtgggaagggatgatgttggaactttgggatgtactgaacatcttgctcaagctttgggaagccaacattttctcagactgactagacacctccttccaccaatgctgagctagtgctcctgtgccatactgggtaagcctctaagtcatgagtaggacttttttgagtggcttgcagtcttccccaggctatgccaggaaagtagttgactaaccctgctgctccaagactcgcatacccatcctgaagtttccgtttatttcccaacagggcaattgcaatctcaatcaatctctccctgccctgggagtcattccactcctgcctaatgaagagactcttctcacatcgtattctcagtttctcttatccatggttaggagtaaaactcatgttcagttgtccaagctttgcttttagtatgtgaatggagctcttagcatgtagaactcccttctcattctcagtaaagtctgactttgaagactacttatcatcttcctagagatgccaaagaataatcaagataataaaggcaggctctgagattcacagctgagtagcaactgtgctgttactctagtacacaccctctcctttcctgtgactgtcaggcttcagggcttacctttattggaaagacagcaggggggcatatatgaagaaaatggaatctttaatattgtcaaagtcttgacccaatagagacattcttgccccagactctcttgcttcagtgcctttgcctgttctggtcctaagtaccttgaatatccttctcttgatgccctgatataaaactctttattcctcaaagccaagttcaggttatcacctccaccacagacttttctttccctccccaaacttcattgcctcttctcatcactccctttgtaatttgtttatactggtaagagagcattcatcataattaggcctatctatgcctacctttcttgttaaattatgagctttgttctgccttggatatctctctggcttggatatctctctggcctttgctctgcacttccaaatgtatccattattcaagacccaggtttccagcctgatcaacatagcaagatcccatctctccaaaaaaaaaaaaaaaaaaaaattgtggggccgggtacagtggctcatgcctgtaatcccagcactttgggaggccgaggcaggtggatcatgaggtcacgagtttgagaccagtctggccaacatagtgaaaccccatctgtactaaaaatgcagaaaattagccgggtgtggtggtgtgtgcctgtaatcccagctactcgggaggctgaggcaggagaatcgcatgaacccgggaggcagaggttgcagtgagccgagattgcgccactgcactccagcctgggtgacattgcaagactccatctcaaaaaaaaaaaaaaaaaaaattagctgggcatggtggcaggcacctgtagtcccagctacttgagaggctgaggtgggaggattgcttgagcccaggaagtcgaggcttcatgagccatgtttgtgctactgcactctagcctggatgacaaagtgagatccttttctaaaaataaggacccagtttattttatttagttatttagttatttttgagaccaagtttcatcactcaggctggagtgcaatggcacagtcttgactcactgcaacctctgcctcctggattcaagcaattcttctgcctcagcctcttgagtagctgggattgcaggtgcccgccaccacacctggctaatttttgtatttttggtagagacagggtttcactatgttggccaggctggtctcaaactcctgacctcaggtgatccacctgccttggtctcccaaactgctgggattacaggtgtgagtcaccctgcctggccagaacccagtttaaattccatcctctctgcagagtcttccttaaccacccctattgaaagttacccctgcttcctacaagaagtggtacttggatgttcatgagatacctgtgcaaggctcctgtgggggtcctggggagacagtgacatggacactcatgaaaggaaccttggaatagcgagtgtgtgtgctataaaatgtgctttagatttgattaccaccacttaagttatgagctctgatatggtttgggtctccatccccacccaaatctcatcttgaattgtaatccctacatgttgagggaaggaagtaattgtattatgggggtggttctcccatgctgttctcatgatagtgaattctcacaggatctgatggttttataaatggtagtttttcctgtactttcacacactcacactctcttctgccaccttgtgaagaaggtgcctgcttccccttctgccataattgtaagtttcctgaggcctccccagctgtattagtctgatctcacgcggctaataaagagataccggagactgggtaatttataaaagaggtttaattgactcacagttttacatggctggggaggcctcacaattatggcagaaggtgaagggggagcaagacacatcttacatggcatcaggcgagagagcttgtgtaggggaactcccctttataaaaccatcagatctcgtgagacttattcactattacaagagcagcacgggaaagacccacccccatgattcagttacctctcactgggtccctcacataatatggggaattatgggagctccaattcaagatgagatttgggtggggacacagccaaactatatcaccagccatgtggaactgttgagtcaattaaacctctttcctttataaattacccagtctcaggtatttctttatagcagtgtgagaacagactaatacaagcaccttgaggtcagaggctaaaatcactttttcccaaacatttcctttttatatatgctacatctttgtgtctgcttcaacatttccagcagtgctttatatatggtaggcatgcaataaatgcttcttgatcgactgacaggtgctcagaagatctaggttggttgattctcttgtgatgccatcttttcctgagagctcattaatttttaagttgttttccttgaaatgcatggtatgtttcctccaccctgctctttgcctttcatagggttccattttgatcagctgctctcattgtctgttttgtgatcaaaggttctgatgaactttggaatatgtgtatgtttggagtgaggatggggtctggaggagatgcatggttgaggaccaattcacccaacccagcttacagaagtaaagcggccccttaggagcactgaagcattgctgtggatttcagaattaccttatttctttttcttttttttttttttttttttgagacgaggtctcgctctgtcgcccaggctggagtgcagtggcacaatctcagctcactgcaagctccgcctcctgggttcacaccattctcctccctcagcctccccagcagctgggactataggtgcacgccgccacgcctggctaatttttgtatttttagtggagacagggtttcaccgtgttagccaggatggtctcaatctcctgaccttgtgatccacccgcctcagcctcccaaagtgctgggattacaggcgtgagccaccgtgcccagccagcttctttcaaatcagagtaggccttccagtgtggcaggccataagatctgaagttttcaccctgttcctggaagccaagtggacagcaactaatttttactttctttattgcacatttggggcttgggggatagagtcagatgtgtgtcagttgaaactgtagctactgcattccactccttgggggatcgtagtgctcatgccaacagaaaacttcgaggctaataattactgtcttcagagtacaagacaggcacggaagttgttttggcataagaaaaccacgatttgcatcccacagtctaaggaagacgatgctgaattcagaagatggtgcaaaagtgtgacagttcagctgtggcggctgttgctgatgcatgggactattttatttacatttcctttcttcttttttaacagagacaggatcttgctgtgttgcccagcctggtcttaaactcctgggcccaagtgatcctcccacctcagcctcccaacgtgttgggattacaggcatgagccaccatgcctgggctttatttatatttccaagtcaaatgttagttggtcaatcagtctttttaagcaccaattttgtgcctagccttgtggaaactgtaggaaaaagatactttttatttgggaggaccttgatttgctgtcacaggtgccactaatgccaattataaggcagtgtggaatcaggtgattgaaagcccagtctgtagcataaactgctgcagggttccagtgggggcaattaaggtgggcagggagggtggatagcatttgactttgacagcataacctgagcagaggcacagtggggatggtgagtgtgcagtgggaggagggagagaggtaagtggtagggaagaggtgggaagggggcaaggagaaggctcaggaggtttggggacagggaaatgacttggttggcgacctcttactttcttctcgtgtgtgcaatttggaattcacttggttcttagtatttctgggtcagatgacttctttgcagtatgagaaaccatttcccaggctggctacctgggctgtggtatcttccagtgctcctctgtgattgtactcagatcagctcgtctaggcaggcaggatggcagaagccctctgacttcatgtctgaaagagtatgtgtttcaactctgtaattacagcatttaacagacgatatcagccctctttgggatggcttttggcaaatgggctagaagtctattgtgcatttaaatgatactgcatcttctctttaaaaggtttctcagtgagtccaccccactctgtatccaagtatgtctcaggccatgaggcaaaaggaaatgagtagttctttttggttggagaattaaaaagaaatctccacccaagtaacaggtacatagtgggaaaaaataacatctgcctgaaagcttcatcttcaggcaaagagagggtcagggggcgggagcttagtaatggggaaacctcagaagatttaaagagaattacagacagacaaggctgaacattggctgtcatccaacaaagctcttataagatgggaatcactgcccggttcttgagctccgacctggagggaagaggagtctggaagacttggcacaggcctgagtgcttcattgtctttctggttccaagtcctcctcagctcactaggaaggaggtggggtgggggcaggtaggccactctgcataagtgcacacatctacactggctagtctacttcacaattcccccacaggttatccttatctctacctggttccagttccagattggagggatatagaataccatccccacccctcaccttgcttgctctggcctggaaaactgtcattcctttaccaccagctggcatctgccatatgcttcaaggaactgaataaagaggaaggggaaagaagaaactagagaaactggaatgcttcctatctgacccccaagtacagggactgcctctttccgtaacggcacagaacgtctccatccctttgacctccacctccccagagatgcccgaggaggacagccttgtttctgtgatctgttgttgagaactgctgctgagaattcttccttcagcaccgccttaggcaccattggtttttcactaggtccgctgtagaaaacagccaggaattacttagttgactaccacctgaggtgctgtttggtgttggtaataaagaataaaggtggaaatgaa

SEQ ID NO: 2 - protein, 467 aa, Homo sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 3 - DNA, 10461 bp, Homo sapiens
cggccgggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttaaaaaaaaaaaaaaaa

SEQ ID NO: 4 - protein, 437 aa, Homo sapiens
MSSILPFTPPVVKRLLGWKKSAGGSGGAGGGEQNGQEEKWCEKAVKSLVKKLKKTGRLDELEKAITTQNCNTKCVTIPRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 5 - DNA, 34626 bp, Homo sapiens
gcgcgcgtcctcaccccctccttccccgcgggcggcggccaggctccctcccctccccttccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaagcacttgctctgaaatttggggactgagtacaccaaatacgatagatcagtgggatacaacaggcctttacagcttctctgaacaaaccaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccagttttgcctccagtattagtgccccgacacaccgagatcctaacagaacttccgcctctggatgactatactcactccattccagaaaacactaacttcccagcaggaattgagccacagagtaattatattccagaaacgccacctcctggatatatcagtgaagatggagaaacaagtgaccaacagttgaatcaaagtatggacacaggctctccagcagaactatctcctactactctttcccctgttaatcatagcttggatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccgaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttacataaaagattatcctatccccccgggagataaatttatactacttaatataaccccacaacaggcgcacaccacacactgcacagtgctatttatacatttttatttatttcagagtttgcctatgctacattagcgctctaatacataagatctatgctgtaaacaaaaacatcttcaaagttgaaatttgctgaaatatacttttaacaaaataacatttttaaggctccattgaaaaatactagataagatataatctcatataatcagtatgaataattttaaaaatgagaaatatttaggtcagccacacttcctttgtgccttgcaagaattcagttctgtggatgaatcagtactggttagcagactgttttctgcaaaccattttaaacatgctttagtatgcaacaaaaagggacctcaaatgctaaaatacactattttacgtggcattgaatagccttgggactggtgtagttttatcaacacttttttattaggaagaaacccaagaaaatttactgtaattgctaccacctgccactgtataaataatctaaaagggacttcccaacattgaacaacaacattgagggctgactcgagatccttctacattgtcacctcagcctggctttgcctgtcactgcttagcttgaagtagtgacactgttctgtatcaggagatttttataatggccctagcatccataattccacatgttcatcaaatggctgaagagtatgagagaagtattaaggtctatgtttgggctgtctccccacttggcatattctgtttttccctcttcaaaatagattgaaagcctcttagtgcaggaagcaggcatcagtatcaaactgatgtcatccaatgtaattattttaagctccaggtttgtctaagtttgggtgaagaatgttcaggaacatgtttgcaacatacagttatccagcttaccctttgacagattcacccttctcatcaaaatagtaagcccaacctaaaaattataagtttacaaataaaggaatagaaaaacccaaaaagctaatttacacataaaaattatcttttgctgcaataaataggtatggaaatatttgtagaattggtttaactgattttgtaaaacaaatgtcatgctattttgccatagtgagacatgcagtaattcttaaaatcacattaatagaaggcaagaacattgaatcagacttagcagataacagattcagtgataaatgaacaatagactaagcatacttaggaagctacatgagaacagaatgtattactgtgctcccgtccaaactgcatgactttattggttatagaataaatggaatttgagatggggatttgccagtttttacagtctgtcttcaatagttttgttggctgcctctgcacctttctaaatgttatgtgaaaataaaattatttaagttctaaagtagtttaggaaagagatgtgatgacaggaaaaagaagttaacttctgaacagtttggtccaggaagaagatgggcagaatacagtaagcccagggttgaagaatacattcaatttggagagatggagaagacctttgaagaaggtcaaaatgagatcttggaacagaactctcacctgtgtgtctggatatacatgaaaactggacggtgttattgagctactgcttatatggtgagcagaaaattgataaccacaagcctggtaggttctgctatgaagcccacatataatcacaaggcctagatagcttggagttaaaagccaaggatagctgtatagtttgggttccatagtttgcagtgagattgtgcttctgagcagtcatttgggggcagtggttctgagattacaagccataacccagccaagaacgggctacctgtggaatgaggatgaggaagttgctacatataaaccctagtgtgtgtgtgtgtattaagtgaaacttagttaacttttttgctcacagccaaagatgattcatctagagaagccattggaattttagcagagttttgtatatatgtggatttttctaataagtagcaaatcagaggccttaaccactgcccaacagcgattctccattgagagtacgtatcttgaacttaagaaattcatttgctctgattttaaatcttgtaaagtttttcttcatgagaggtcttgcctctaaactatattgtggcagtatttgatcaaactacataagtaccatgtaaataagattttaatacaaatgatgactcacttctaaatggtttgccatttagaaatgtgctgctgtgagaaaaacgaattttttttttttttttttggagacagagtcttgctctgttgcccaggctggggtgcagtggggcgatctcggctcactgcagcctcgcctcctgggttcaagtgattctcctgccttagcctcctgagtagctgggattacaggcacacaccaccacgcccaactactttttgtatttttagtggagacagggtttcaccatgtttgccaggctggtcttgaactcctgacctcagatgatttgcctgcctcggcctcccaaagtgctggaattacaggcgtgagccatcatgcctggctgaaaagtgaaaatttaagccagcttaccacctggaataaaaatgttttataggaatgtctaggttgctcttttatattgaaaaaaaacttattagtgtctgttttacccaagaaccacaagctacttcatttcaacttttaaatcatgaataataacgtgttatcaccacatttaaaaatgtacatcgtcaatcacaaacacatattctaaggaattgaattttatagagataattgaatgctttcatctgtaaaagaattagtggcctgcaaaccactgtggattcttgctatgctttgaagttgtcagtgggggaatttgctgctgcaagttacttagacttgtaggcaaagggaaattcaaatttttaattctaaaatgaaaaccactgacaaaattttatactctgaaagtttggttgttagcttagtcattattttcctgttctttatcatttcggaattcagatgcttaaatttaacatacaaattatttgttggtaaaacataaaacataaaaagctacatttggtaaactaaattttaggattcaaagtctctaacaatttctatgtgacatgtcatacggtgcagtttttatttgccaaagtgtctacttcatactgcctatgcactgcttcccgtttttaatctctctaccccaacccccctataattaaataaacccctagaaaactgccttcttttagaatacctaattgattactttaaatattttttcagaatcaaaattacaaaagggagagatacctaagaatctggcttgtttatattctttaaaagatcgcatttgattgaaggtgggtgcatattttttatatccactctttccccatttgtatgtgaccattgtaaaagtggatgtgcttttttttttttgctgaggtctagagacaatgttttagagatacagaatgaaacatttatgggtaaaatacaatgggtaagacttgcttcaaaatagtatgtgacagaggaagtagatggaggtatgaatgaataggacattgatggttgtttgttgggattgggtaagggagctttgttgtattctatttccttttagataagtttgaaattccttgtagtgaagaaattaaacgtctccatcaggtgcattgccacgtcttctctaggaagcctccttaacatcctctggtggctcctgaactttttctgttctcattcacagggaagctcatggggctgcctggagacttgaggttacatcttgcctagtattaccaaaattgtgatacttttctccaccccataatagcacagtctttggtctcaacttgaactaaagtctttttttttttttttttttttttttttagtatttattgatcattcttgggtgtttctcggagagggggatgtggcagggtcataggacaatagtggagggaaggtcagcagataaacatgtgaacaagggtctctggttttcctaggcagaggaccctgcggccttctgcagtgtttgtgtccctgggtacttgagattaaggagtggtgatgactcttaacgagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcctagtacagaacaaaatggagtctcctatgtctacttctttctacacagacacagcaacaatctgatctctctttcctttccccacatttcccccttttctattcgacaaaaccgccatcgtcatcatggcccgctctcaatgagctgttgggtacacctcccagacagggtggcggccgggcagaggggctcctcacttcccagacggggcggctgggcagaggcgcccccccacctcccggacggggtggatgctggccgggggctgccccccacctcccgaacggggcagctggccgggcgggggttgccccccacctcccggacggggcggctggccgagcaggggctgccccccacctccctcccagacggggcggctgctgggcggagacgctccttacttcccggacggggtggttgctgggcggaggggctcctcacttctcagacggggcggccgggcagagacgctcctcacctcccagacggggtggcggtcgggcagagacactcctcacatcccagacggggcggcggggcagaggcgctccccacatctcagacgatgggcggccgggaagaggcgctcctcacttcccagactgggcggccgggctgaggggctcctcacatcccagacgatgggcagccaggcagagatgctcctcacttcccagacggggtggcggccgggcagaggctgcaatctccgcactttgggaggccaaggcaggcggctgggaggtggaggttgtagcgagccgagatcgtgccactgcactccagcctgggcaacattgagcactgagtgagcgagactccatctgcaatcccagcacctcgggaggcccaggcgggcagatcatgcgcggtcaggagctggagaccagcctggccaacacggcgaaaccccgtctccaccaaaaaatacaaaaaccagtcaggcgtggcggcgcgcgtctgcaatcccaggcactcggcaggctgaggcaggagaatcaggcagggaggttgcagtgagccgagatggcggcagtacagtccagccttggctcggcatcagagggagacggtggaaagtgggagaccgtagaaagtgggagacggggggagacgggagagggagagggatgtgctttttttctaaccgttattgccaccaagtaataatgtcttaattcacaatttacatagtgattggctggagagaggtattgagcataaatttttttttaagattcaactgggaaatggatgatttacatgattttagtctctttagttgtctgggtatttcttgactgggaatagcaatatcttaaaggccatttttaacaagaatgctaaggatggaacacttgaaggaagcagtcctgtacagtcaaatacttcagttaccttggataatagaatgaaaactcaattgcctactttgaacaaattttttttttggattttaatggctggacagaataacattctgctaattttaatccttggtcatttccgatgtaatggaaaatgcagtttgactcagaatcggaggcctggggtttggaccctgattgtgccaatttatgtgactttagataaatcttttcatcagtctaccttaaagttcttcatttcctccagttccctaaaatgaggaagttagtttttagggtggttatgagaactaaatgagagcacttgagagatcattcagcctgaagtgggtactcagtattagatggctaaatctgcacagtctagaataccaggcaaaggttactctgaaggtctttgctaataacaaatctttctctaagaaagtttgtaaatgtgatgttaaactcagaaatgtcacatagaacatattggagcaattattgccgcaaaagtaactcgtagcaaccacaaaaacccagtggtgtgcagcaataaacagtttatgaattagataagtgatttcggctagatgtctctggagcagttgtagtctttcctcgttcatgagggagttggcctcacctggaaggacttggcatttttccacatgcctcctatcctccattaaacaagcatgtttttgtggaggttgtagaaggcaacaacagccaagcccaatcccataactccctttcatgtctgcatgcttcatgctaactagcattcaccagaaacaagccacatggctaaacccagtgtggaaaggcactacagagttattagaccaagggagagaacataggaggggtgaagaattggagccttaaatgcagtcaatctaccacacccttgctttgtatttaacaggttactgtactggtttgccagcaaacaatggaaaatgtggagaagctgaagaatgctcaagctgggacttaatagagtggcctatttggtttgaaatgttttaacttacagagcattgagtagaagcctaatctaatatacataaggaagacaaaagcaaaggattgtgttttctatctaaaggttaatcattgtggttgctcctggccattatcacatgactggaagttaacactctccaaacgctgagcctatcctgtacagcactagaaagtagaaagaatcactcaattcagggaaaccgttttctcttaatgtgaacatttacattaatgccatttccaaaacctttctgggacttcttaaatgcaaagatgctatctgctttacttcatgctgcctgtttttaggagcttggagtgctttaggaagcttcccaatactggtttagcagtaatttggttgactgatcaaggcatgttttaactttgacactgaaattttaaaaagacaacagttatcttgcccggagagtcaagtttctgcttccaaggaggtcaggaattgttctctttggtgatgtggctgtgcttggtagcccttgaaagtggagtcgacagcagtcctcagcttttgtgtgcctgtcttagtctgttttgtgttactataacaggatagctgaggcagggtcacttatgaaggatgctcacagttctacaggctgggaagttcaagggcatggccctggcttttggcaagggctttgctgctgcttcatagcttgatggagaaggtcagaggggaagcagacgtgcaaacaacccacttgttcacaacaaccaaacaagtctctttttaacaacccactcctggggactaatctagtcttgagagagtgagaactcattgcaagagcagcaccaagccattcatgaagcatctgcctcagtgaaccaaacatctcccactaggccccagctctcaacaccaccacaatgaagataaaatctcatcatacatttgagggacagtttgggagacagaccatagcagtgctcagtatttctacccaaatgttcaggtaacttaatatatttttccttgaatatatgtttaaatgggcttcccttccccacgctcatcttgaatggtcccacaacaacttttgattatcacgttcctgtaaatacacaaaaatattttgtggtcttttactggcagcccagtggatgggactttaaaaaatcacccagattccaacaaccagagaaaacgactggtgtatattttttccagtctttatttgtatgtctgtgtatattcaatggaaaatgtttgaagcttcactcacagcacattccattagagaaagctactaaaatcataaggaaaatctaaaatgcagtaagccagtcagcaagccataatgggcatatgaaaacaaagttttttgccatgatttgtggaccacagaagatctgtgttattagtctatttaagtttggtgtttgaaattaaaaatgttcgacatactttttatgttttttttaaatatactgtctatatttaaaattgagtatactgtactttagtgtgtttggaagcagatatccccaaataaaagtatacagtagaaccaaagaattttattgatcagctagaatttagttttcaggtgtaataactgtcaacctaaataacagaggctttctaaaagaaaatgatgtttatttgggaatagggcattgtgaaggcaatatgcatgccatagtaaactgtgtgtattcaggaaggtaaaggaagacaggtttttaaaggacagataaagattatataattgtcttgaaataattattcttggctacaaggattaataacaaggatgctgccagttcgggtttggacaatcggcttctaggcagatgtcccaaaagtattttctgtgtaaggttgcgaatagtgtttgtgcaagctggcgtggtttcttctgggtctttgaggtagtgcgtaaaatccctctcttcatggacttccctggctccatttgtcagggcttttggaaacatgactcttgattctgacagctttcacctttccctctcttgatgaagatgtttttccgaaagtatctatgatgaatcatcttgtagttaggctttgattgtcccttggtgacagaatagacctttcccgggttattggtctggtcctgcatcctgcattggcaggagtgattggcaactaaaagtcagtgttaaaacccttttagccacctttgagggcagggaggctttaagggagtggcacttaggctaagtccacctggagtctattattaagtccaattttttttccttagtcctttgttgtcccctcaaagtgctgggctagcattattctgttaggaattgtacttctttctgcagaaaatttggcaaataacagatacaaagtttaaaaaggaaatacacaaaattaatagtaatgtgacaatcccagtttgcataatggttttgagccctgaacctaggcttacaggcaaccaattgaataaatcaaattgtaatacaattcttgctctgatgtcttaggaaaaatgtctacagcctgaaatcatcaactttttgtcctggtttgcagtttgaatgtctctagctatggcattggttggtatggtgaacttttgtgtgacccatacatcagcatgagacttgctcctttaaaaattaatcacatcttagcttataggcctcagagcatgggagtagttttttttcttagagagtcatagccaaatattgaaggaaattaggaggattcaggagcaaatccagtctgcaggtggataacaggagtttcaaaacggtacagagctgtgatctaataacaggtacatatagctttcttcagaaacttaaagttaccctgatttttaccaaagatgttcagaataaaacagatttgtaaactttatcagattttgtctgcaagaatagtagtatggtcacagtaatctcagatttaaaaacctccttgaggctaagaagctaagtcaaggtagactttagattttacctatagttttaaggttcctgggcctgccaggaaatgataatttttaattcagtgtaatgctgagaaccattgaagccaggcattctacacattctcaaatatgacattttaatcaaagccttggtaatacaaccagtgtttccaattgtatcctgttataacgagagccgatttttattgaacttaggcaaatcatattgccttaagagtactcacaaataggctgggcacagtggctcatgcctgtaatcccagctctttgggaggccaagacaggtggaacacctgaggtcaggagtttgaaaccagcctggccaacatagtgaaacctccccccggccaccgtctctactaaaaaatacaaaaattagctgggtgtggtggtgcatgcctgtagtcccagctacttgggaggctgagacagaattgcttgaaccctggaggcagaagttgcactgaaacaagatcgtgccactgcattccagctggggcaacagagcgagactccgtctcaaaaacaaaaacaaatgaatactcaaaatagtttccaaattggagggatcaagaagaaaggaaaagcaaatatttctacctttgttcacaaaagtattccaaattgctgtaaactatagatagcatgagagaatttctttaaatatggaaaacaaaacatttaagtaaaaaaacaataatgcttcaaataaaagtcacagacacatcttcagttacttagtctcatgtaactttttttgttgtggttgatcttaattagtagttacatggactcatcagtttcttgaagttctgaaaaaatatttagtccattggtattaaagtgattagtaacctgtatttaaaagtgtgttagcatcttttccatgaatctgattgcaaatgcttttagagaaaaagcaataactgggaattacaaaaacttagaataaccatgattaaaaatctgatgagagtttaccataaccagaaatagacaaagagttttggttatttttgtggcaaacagcataatcagaattatgactgatgacatatttctaacggcatcgtacaattttggaacactcatatcaataacatactcataaatgtaactgtgtctagtattacatcattagacaatgcttttcatacaatttaatacatcaaagaagcctaattagctaacatctctaccagatggcatacacatgctctgaggctttccagaggcccaagtggaaaactcaaaggtaattttaagtcaaaaacacttaatttagaacttgagcctagagaagcctgtcaaagatgtcaaaagttcgaaacaggatcacaggtcactataaaatatttaacaagaatgataatcaaaagacttaagaagcaatgcagaaagttacatacatttaaaaaccatcttttcaaagcttcatttttcccaagcaaaaaaaaaacttaaacacaagaatttatcttgatagaacataaaatttttcttaggccagttgccaaaatggtaaagaaaaatctcttgcagtgtgactgcctttacttatgggaagcctatttggatatactgaaagttgaatctgatgaaaaggtacttgaatttaatcagacacaggaagagtatttccaaggttatgagtgtacgccttatagaggaatgtaaataagaaagctagtatgttgaacagaatacatggctcttggaaaaattacgagaaatttcctgcttgcgtggaacaattcaaacatgagaagagccaagaattcagaatcaagttatactggaggaaaacattgcttttctaggccttctacagaacatttcagtatcaagttataacagcaagagttagaaccagaggaaaaaagttacaggagctaatgaaaaagttaagagttatcacccctgccaaacaaaaagatgtaccttcttaaggggagaaagagctaaaggcaatgatgtgtgacctacaaataaggtgcagcaagatacagcaaaggttgaacttgtgagatataaatcaggatcttcaagaagaaaactctacctcaagaaatgaaatgaccatcttaaatgaaaaaagacagcctttctaacctgaatctaggggaaattaaacggatctcagaaggaaatatggcagaaatttaaactgtggtttagaagatggctgattttagaattaaaaattaaaacctctttcaattttattaagaccagatccttaaaaagaaccttgttctaacattggggaccaaattttgtgtgtgtgtgtgtgtgtgtgtgtgtgtgtgtgtgtgtgtgtgtatagtgcatgtatagcatttacactatcgtgtatatacaaatatatagcatatgtatagaatatactgtattattgtacatatacatatgtacaagtatatatgtaagctcaatgtcttatgatttcattctgacctattgccaacttcattacacacaactcctttcataaatgtatccttcatgaacatttcatgatctgcacagaccttcagtgacatgcttaaactttctgctttgttttatacttccccttaaacaactggtcatcctgctttaggataaaaagttactatgcaagactcatacagaattattctgttaattttgtaaccttccttaccaaaggtacattctcacacccattaacttccttcatatttctctcctcctcctacttagtggttcctttctgtcttgtttccatatttgaaacaacctctaataaactctgaatttaaacaacttttttcccaataaaaagcaatttttatgccttataacttttctcatcaaaacatctttttttgggtacactttgtatatggaattgtgtattttcaaattttaacttattaaccttaatttttagtgaaaacctaggaagcaaaattttgaagtgttatatcagcattttataaatgagaaccatattataatttttagaaacatgtttccttataactttgtatattaataggcccaaatatatttagtctttctataatttaggaagccaagaacaaactaatattttcagcagtttattgtttttttttggaaatgatccagacatttactgaagattaatttataagatttcaaattacatgaaaagttcattaacatcctatttttaaaaacattcttttggtttattttttagagacaatgtcttgctgtgttacccaggctggagttcagtggctgttcacaggcacaattgtagcacactgcagcctcaaactccaactcacacaatcctcctgcctccgtttcctgagtagctggaactatagatgcatacctgcataccaccatgtctcacccttgcttatcccgtttataatccatccaattcttttttttttttttttttttgagacggagtctcgctctgtcacccaggctggagtgcagtggcgtgatctcggctcactgcaagctccgccttctgggttcatgccattctcctgcctcagcctcccgagtagctgggactacaggcgcccgccaccgcgcccagccaattttttgtatttttagtagagacgaggtttcaccgtgatctcgatctcctgacctcgtgatctgcccgccttggcctcccaaagtgctaggattacaggcgtgagccactgcacctggcccccaattcatttttaacaattattcctagattacttataaaaactgagatattagacatagctagtcatttcaagttattttcctgttaaccatttttattacctgtgagtatcatgtgttcaattaagaaccataaaaatgaaatatgtaggtattttgccagtaactcagaggacacagctgaagtcaataatacaaaattagttcaacttacagttatacaaagatcattctgtttttaagttgagtttatagttttatgaccttaaaaagtctaacagagacaaatataaaactgagtagtaaattcaggcaaaaattttaaagacacttatttttgatttaccaattattttaaaaccagcttatcagatgtttaagttatattaactaaaaggcacttgtgttaattactatatattttgtattagcactcatttatttgatgaatagaattccttaagggatttgtggccaactgccagattttaccacgtagacacaacatacaacatatatatacatatgtgtaaacacacctaaacatacacatacacaaacatagctttcattttagaattttagtcatacgatagtaatacaggcttgctggtttataaaagacagttattggattcaaattatatttctgagaaagtgggacctgctcagctgggtaaacatgcagaataggtaatcttatgaaagctgtgaaccaaaagttttggtaaatagcagtttggatttttaaaaaacctcttaccccacctccccaaccccttttttcccttttttcagtttcaaatgagtttaatgttaatatttaaatgcttacatttttagctaggactggctgaattgtataagaaaaaacaatctccaggtggccttgaatttttagtaacaaatcttttgtttgccattctggtttttttgactagtcagtgcaggcagggaagcattttagcagttgtggatgaggggtttttgttttgttcttttagcctttgcatagcaggcaagcaatttttatgctataccagagataccttatattattgccctgagctcaagattttgacctgtttgagagcctaatttttatacgtatttatctagttcttttaggctattaatcctttaattaactgttccatcaccctaagcagttattaggcaaacctaaatttacattaaaagggatacttcttaattctaggtgttggttgccagggaactattataatttataaagccattaatttaaggccctttaagacctttttttttctttttgttcttggctggaatgccgtaaggagtgagtttcatctcaacactggcagaaacagcagatttaaagtaggcagaaaaaaaattagagagcttagaagactctacatatcaactctatagctgcagtctcttggtactaagaataaaaaagcttggggagtttagacaaagcatagacaatctctatgatggtcattgatccaaaaacatgcatgaggaaaagccacatagctgacctgaagtcccagaaaagcaggcatgccttaatgtttgagaatttccattttgtttcttctcaatctcttaagagcaaagaaaattctgtaaatcctgacagataagtcaggtgtttggaccagtgttttaactggtggcgattgccctagtggctttaaaagagccatcctgtgcccaaaatttagaatgtttatttttgctcttgggagatgttcagaaacaggggaaaagagccaaatcatttacagatgcatgtaaccatatcgaaacgaaaccaaaatcagtgttcccaaaagtgttaacccagtcatgcagattaaaaaataatataaacacagaagaacccaaagtaaatttaccagaaaaggcatgcctcagaatccagagtactcagccaggcgcagtggcccatgcctgtaatcccagcactttgggaggccaaggcaggaggatcgcttgagcccatgagttcaagaccagcctcagcagtatagtgagacactgtctctaaaaaaaaattgtttttaaatccagagtactcaaaccagagggacacttgtctttatatcaaaaaggacttgccaggaaagacaaaaagtcttttgtcatcccaggagggatgtaaagtcctttattaaagtggtcttagaaccaagacaaatccaaagtcaagtcaaaaagcctctgccaaaagtgggaggctctgcctgagaaaagactcactggggcagaacagacaagctatgtaagcggagagcccaaagggctcctgtgagtactgcatactgattctgagatcaccacttctctctgaaatgtgtcctacttcaggttctactgctgaacaccatttatgtcaacacagagagaggctctctaaaagaaaactctatttgggaatacagcattgctgtagaaatacgcatgtcatgggccgtgcgcggtggcttatgcctgtaatcccagcactttgggaggctgaggtgggccgatcacgaggtcaggagtttgagaccagcctggccaacatagtgaaaccccctctctactaaaaatacaaaaaattagatgggtgtattggtgggtgcctatgatcccgctacttgggaggctgaggcagaagattggcttgaacctgagaagtggaggttgcagtgagcctagatgtgccactgcactccagcctgggcgacagtgcaaaactacgtctccaaaaaaaaaaaaaaaagacccatgtcatggtaaactacgtgtgtattcagggaagtaaaggaagacaaagattttaaagaaaaatgagggttgtataattgttttgaaataattgtcgttggttacaaagatcaatagcaagggtggtgccactctgaagttggacaggcagtggctaggcaaaagtattttgtgggtaacctttgtgaaaggttgcagtttttgtaacacaagctgctttattttcccaaaagctttcacagtacatagaaaatatattggacgtgtattaaatgtgccaaattagtcagcaatattacattaaaatatgtgttattacttgttaatgttcttaataagttgttcaggcagttataccagactatcttttctcattttccaatttataagtgtattatccaaaaatgttagttttagggtgaccactgtatattttggtattttttaaagctacccaattgtgtataatttataaaaatctttttttcataagacctaaaacttctgaacaatacataggtgcaaataaataaattcctttttatctcaaactcacttccactgccctccctgaagaaagccttttgttattgttgtcttgactaaatgtggcatgggagctaacattttcaagggaagctgatcttatctccgggctctagaagccaagacatgaggtatgtgtttaccgtctcttaggtgactctccagaactttcattctcaacctcctccctcactgccagttcctcctcagcttcttagccaagtggtagaggaaaaatggtattttatgtcaggactaagccatgtgctctgagccctgggtaagtctgcaaggcttctctagaactcatacataggtcaattattcctcctctgaaaacttaaactctggcaccactagctttttcctacagcatacatgggctcagtaaatcctctgttaagacaacaggaaaattaagacaatgtccttgcaagccccataactactttctatccctgctattcacagccaagtgtgtcgagaccagttcacacaaaccttgttgattttcggtttcaccccctccttactaaatcacccctccatttgctgcagttgcccttgcgtgctgtactcagacttggaggaagtgatgtcttattcaaggccagtttttgtactagtggttaaataaatggtttccaaattggagtcagaaggagagcttctaaaatgtaggttccctggcctcaattgtgagattctgctttagcaggtctggaattggagcactgggatctgcattttcagaaaacccaaaatgattatcagccaggacttaaacctctgctttagaccacattccctgtgggctttcagattttctatcaatgttcttccctcttcccagctcccacacattaaaactcagatcatgcagaaaagaagttacagttccttcatttcacatcaatttctcatgcatcccatctggttttgggaaggtgtgggacgaggtggatggccttaaacttgccaatcaaagataacgttctctttcgattcaaatagcctatctcaggcttaaaaccatctctttggataaatgctcagcttttcaaaggttcttcctagcttcttcctcatgatggcatctagtgggtgagaacagtcatctccaggtgacacaggaaagagtttctctaatgtatgtgctgaggtccttgacggtcctgctgctggtgctcatcctgccatctttgctggatgtcactgagtctactgggtaatgtaagtgggtccctggcttttgttcactgctgtcatgccctgctcctgaccacaactctgtcattgcctttggtctcaaggtctctaccttaatagcttccatgtcccaactatgggactgttaatctgctgggctttggagtgggtgggaagggatgatgttggaactttgggatgtactgaacatcttgctcaagctttgggaagccaacattttctcagactgactagacacctccttccaccaatgctgagctagtgctcctgtgccatactgggtaagcctctaagtcatgagtaggacttttttgagtggcttgcagtcttccccaggctatgccaggaaagtagttgactaaccctgctgctccaagactcgcatacccatcctgaagtttccgtttatttcccaacagggcaattgcaatctcaatcaatctctccctgccctgggagtcattccactcctgcctaatgaagagactcttctcacatcgtattctcagtttctcttatccatggttaggagtaaaactcatgttcagttgtccaagctttgcttttagtatgtgaatggagctcttagcatgtagaactcccttctcattctcagtaaagtctgactttgaagactacttatcatcttcctagagatgccaaagaataatcaagataataaaggcaggctctgagattcacagctgagtagcaactgtgctgttactctagtacacaccctctcctttcctgtgactgtcaggcttcagggcttacctttattggaaagacagcaggggggcatatatgaagaaaatggaatctttaatattgtcaaagtcttgacccaatagagacattcttgccccagactctcttgcttcagtgcctttgcctgttctggtcctaagtaccttgaatatccttctcttgatgccctgatataaaactctttattcctcaaagccaagttcaggttatcacctccaccacagacttttctttccctccccaaacttcattgcctcttctcatcactccctttgtaatttgtttatactggtaagagagcattcatcataattaggcctatctatgcctacctttcttgttaaattatgagctttgttctgccttggatatctctctggcttggatatctctctggcctttgctctgcacttccaaatgtatccattattcaagacccaggtttccagcctgatcaacatagcaagatcccatctctccaaaaaaaaaaaaaaaaaaaaattgtggggccgggtacagtggctcatgcctgtaatcccagcactttgggaggccgaggcaggtggatcatgaggtcacgagtttgagaccagtctggccaacatagtgaaaccccatctgtactaaaaatgcagaaaattagccgggtgtggtggtgtgtgcctgtaatcccagctactcgggaggctgaggcaggagaatcgcatgaacccgggaggcagaggttgcagtgagccgagattgcgccactgcactccagcctgggtgacattgcaagactccatctcaaaaaaaaaaaaaaaaaaaattagctgggcatggtggcaggcacctgtagtcccagctacttgagaggctgaggtgggaggattgcttgagcccaggaagtcgaggcttcatgagccatgtttgtgctactgcactctagcctggatgacaaagtgagatccttttctaaaaataaggacccagtttattttatttagttatttagttatttttgagaccaagtttcatcactcaggctggagtgcaatggcacagtcttgactcactgcaacctctgcctcctggattcaagcaattcttctgcctcagcctcttgagtagctgggattgcaggtgcccgccaccacacctggctaatttttgtatttttggtagagacagggtttcactatgttggccaggctggtctcaaactcctgacctcaggtgatccacctgccttggtctcccaaactgctgggattacaggtgtgagtcaccctgcctggccagaacccagtttaaattccatcctctctgcagagtcttccttaaccacccctattgaaagttacccctgcttcctacaagaagtggtacttggatgttcatgagatacctgtgcaaggctcctgtgggggtcctggggagacagtgacatggacactcatgaaaggaaccttggaatagcgagtgtgtgtgctataaaatgtgctttagatttgattaccaccacttaagttatgagctctgatatggtttgggtctccatccccacccaaatctcatcttgaattgtaatccctacatgttgagggaaggaagtaattgtattatgggggtggttctcccatgctgttctcatgatagtgaattctcacaggatctgatggttttataaatggtagtttttcctgtactttcacacactcacactctcttctgccaccttgtgaagaaggtgcctgcttccccttctgccataattgtaagtttcctgaggcctccccagctgtattagtctgatctcacgcggctaataaagagataccggagactgggtaatttataaaagaggtttaattgactcacagttttacatggctggggaggcctcacaattatggcagaaggtgaagggggagcaagacacatcttacatggcatcaggcgagagagcttgtgtaggggaactcccctttataaaaccatcagatctcgtgagacttattcactattacaagagcagcacgggaaagacccacccccatgattcagttacctctcactgggtccctcacataatatggggaattatgggagctccaattcaagatgagatttgggtggggacacagccaaactatatcaccagccatgtggaactgttgagtcaattaaacctctttcctttataaattacccagtctcaggtatttctttatagcagtgtgagaacagactaatacaagcaccttgaggtcagaggctaaaatcactttttcccaaacatttcctttttatatatgctacatctttgtgtctgcttcaacatttccagcagtgctttatatatggtaggcatgcaataaatgcttcttgatcgactgacaggtgctcagaagatctaggttggttgattctcttgtgatgccatcttttcctgagagctcattaatttttaagttgttttccttgaaatgcatggtatgtttcctccaccctgctctttgcctttcatagggttccattttgatcagctgctctcattgtctgttttgtgatcaaaggttctgatgaactttggaatatgtgtatgtttggagtgaggatggggtctggaggagatgcatggttgaggaccaattcacccaacccagcttacagaagtaaagcggccccttaggagcactgaagcattgctgtggatttcagaattaccttatttctttttcttttttttttttttttttttgagacgaggtctcgctctgtcgcccaggctggagtgcagtggcacaatctcagctcactgcaagctccgcctcctgggttcacaccattctcctccctcagcctccccagcagctgggactataggtgcacgccgccacgcctggctaatttttgtatttttagtggagacagggtttcaccgtgttagccaggatggtctcaatctcctgaccttgtgatccacccgcctcagcctcccaaagtgctgggattacaggcgtgagccaccgtgcccagccagcttctttcaaatcagagtaggccttccagtgtggcaggccataagatctgaagttttcaccctgttcctggaagccaagtggacagcaactaatttttactttctttattgcacatttggggcttgggggatagagtcagatgtgtgtcagttgaaactgtagctactgcattccactccttgggggatcgtagtgctcatgccaacagaaaacttcgaggctaataattactgtcttcagagtacaagacaggcacggaagttgttttggcataagaaaaccacgatttgcatcccacagtctaaggaagacgatgctgaattcagaagatggtgcaaaagtgtgacagttcagctgtggcggctgttgctgatgcatgggactattttatttacatttcctttcttcttttttaacagagacaggatcttgctgtgttgcccagcctggtcttaaactcctgggcccaagtgatcctcccacctcagcctcccaacgtgttgggattacaggcatgagccaccatgcctgggctttatttatatttccaagtcaaatgttagttggtcaatcagtctttttaagcaccaattttgtgcctagccttgtggaaactgtaggaaaaagatactttttatttgggaggaccttgatttgctgtcacaggtgccactaatgccaattataaggcagtgtggaatcaggtgattgaaagcccagtctgtagcataaactgctgcagggttccagtgggggcaattaaggtgggcagggagggtggatagcatttgactttgacagcataacctgagcagaggcacagtggggatggtgagtgtgcagtgggaggagggagagaggtaagtggtagggaagaggtgggaagggggcaaggagaaggctcaggaggtttggggacagggaaatgacttggttggcgacctcttactttcttctcgtgtgtgcaatttggaattcacttggttcttagtatttctgggtcagatgacttctttgcagtatgagaaaccatttcccaggctggctacctgggctgtggtatcttccagtgctcctctgtgattgtactcagatcagctcgtctaggcaggcaggatggcagaagccctctgacttcatgtctgaaagagtatgtgtttcaactctgtaattacagcatttaacagacgatatcagccctctttgggatggcttttggcaaatgggctagaagtctattgtgcatttaaatgatactgcatcttctctttaaaaggtttctcagtgagtccaccccactctgtatccaagtatgtctcaggccatgaggcaaaaggaaatgagtagttctttttggttggagaattaaaaagaaatctccacccaagtaacaggtacatagtgggaaaaaataacatctgcctgaaagcttcatcttcaggcaaagagagggtcagggggcgggagcttagtaatggggaaacctcagaagatttaaagagaattacagacagacaaggctgaacattggctgtcatccaacaaagctcttataagatgggaatcactgcccggttcttgagctccgacctggagggaagaggagtctggaagacttggcacaggcctgagtgcttcattgtctttctggttccaagtcctcctcagctcactaggaaggaggtggggtgggggcaggtaggccactctgcataagtgcacacatctacactggctagtctacttcacaattcccccacaggttatccttatctctacctggttccagttccagattggagggatatagaataccatccccacccctcaccttgcttgctctggcctggaaaactgtcattcctttaccaccagctggcatctgccatatgcttcaaggaactgaataaagaggaaggggaaagaagaaactagagaaactggaatgcttcctatctgacccccaagtacagggactgcctctttccgtaacggcacagaacgtctccatccctttgacctccacctccccagagatgcccgaggaggacagccttgtttctgtgatctgttgttgagaactgctgctgagaattcttccttcagcaccgccttaggcaccattggtttttcactaggtccgctgtagaaaacagccaggaattacttagttgactaccacctgaggtgctgtttggtgttggtaataaagaataaaggtggaaatgaa

SEQ ID NO: 6 - protein, 467 aa, Homo sapiens; identical to SEQ ID NO: 2

SEQ ID NO: 7 - DNA, 8863 bp, Mus musculus
ggttaaaataactatctgagatttgttttgctgttgttgttgtttaaggaaaattaaggtagtaccatatcttaaatcattgcaacaagaggcagtattgctacttataaaagtaaataatagtgtataaaattgtgtttcaaccgaatcttactggcatctttctctctttcttggaaacactccatgaaacaatagatgcagtagatcaggatgatggggacgggaatgggggcactactacactactatactactacactctaggatgcgaggctgcatgcagagttaacaacagtcagctgactgtttacctgaaagactggcatagaataggaaaatttggtgccaagtgcataaaaataagcaaatgaaaagacattaattctgggtagatttaccgggctttttctgagtgtggattgttacctttggtaagaaaatgtcgtccatcttgccattcactccgccagtggtgaagagacttctgggatggaaaaaatcagccggtgggtctggaggagcaggtggtggagagcagaatggacaggaagaaaagtggtgtgaaaaagcagtgaaaagtctggtgaaaaagctaaagaaaacaggacggttagatgagcttgagaaagccatcaccactcagaattgcaatactaaatgtgtcaccataccaagcacttgctctgaaatttggggactgagtacagcaaatacggtagatcagtgggacacaacaggcctttacagcttctctgaacaaaccaggtctcttgatggccgtcttcaggtttcacaccggaaagggttgccacatgttatatattgccggctctggcgctggccggaccttcacagtcatcatgagctcaaggcaatcgaaaactgcgaatatgcttttaatctgaaaaaagatgaagtgtgtgtaaatccgtaccactaccagagagttgagaccccagtcttgcctccagtcttagtgcctcggcacacggagattctaacagaactgccgcccctggatgactacacccactccattccagaaaacacaaatttcccagcaggaattgagccacagagtaattacatcccagaaacaccaccacctggatatatcagtgaagatggagaaacaagtgaccaacagttgaaccaaagtatggacacaggctctccggctgaactgtctcctactactctctctcctgttaatcacagcttggatttgcagccagttacttactcggaacctgcattctggtgttcaatcgcatactatgaactaaaccagagggttggagagaccttccatgcgtcacagccctcgctcactgtagacggcttcacagacccatcaaactcggagaggttctgcttaggcttgctctccaacgttaaccgaaatgccactgtagaaatgacaagaagacatataggaaggggagtgcgcttgtattacataggtggggaagtgtttgctgagtgcctaagtgatagtgcaatctttgtgcagagccccaactgtaaccagagatacggctggcaccctgcaacagtgtgtaagatcccaccaggctgtaacctgaagatcttcaacaaccaagaatttgctgctcttctggctcagtctgtcaaccagggttttgaagccgtttatcagctaacccgaatgtgcaccataagaatgagttttgtgaagggctggggagcagaatatcggaggcagacagtaacaagtactccttgctggattgaacttcatctgaatggccctctgcagtggctggacaaagtattaactcagatgggatccccttcagtgcgatgctcaagcatgtcgtaaacccatcaaagactcgctgtaacagctcctccgtcgtagtattcatgtatgatcccgtggactgtttgctatccaaaaattccagagcaaaaacagcacttgaggtctcatcagttaaagcaccttgtggaatctgtttcctatatttgaatattagatgggaaaattagtgtctagaaatgccctccccagcggggaaaaagaagacttaaagacttaatgatgtcttgttgggcataagacagtatcccaaaggttattaataacagtagtagttgtgtacaggtaatgtgtccagacccagtattgcagtactatgctgtttgtatacattcttagtttgcataaatgaggtgtgtgtgctgcttcttggtctaggcaagcctttataaaattacagtatctaatctgttattcccacttctccgttatttttgtgtcttttttaatatataatatatatatatcaagattttcaaattatcatttagaagcagattttccttgtagaaactaatttttctgccttttaccaaaaataaacaaactcttgggggaagacaagtggattaacttggaagtccttgaccttcatgtgtccagtggatcttagcagtcgttcttttgtgagccttttctcctgagttgcattagaaggaaaccttactggaaccgtccaggctcctcatcccattcctgttctggttcagagcagtacagcagaatgacgtcgtgctaaacagttgcactgctggcttctgggttagttgtttctgagtccaggaaaggtttgtgtgggcagtaagtccttttgtctaataaccagacttcagcagatgataactgatgtgtataaccagttgttctgttgattaacttttgtctcaaacatgcacaggtggcagtataattattttcagggctattctagaatcatctcagtctgtttccttcttccaaagccagtctaataataaagtacctttctgtaaaggcagccgaccttttgcctcattttacttttactaccaggttgtattacagaacagaccttttgtaaatgtgttagagtgacgctgaggtcttgtcagcagatagggccatctgtttttaaagtgtattgtatgtaatttataagtagaatgttattttacctagcttcaaaggtttaaatattgtgagctaagccatttagcaagatttctagcccgcagttagctgtggacttagctcttcctgacttaccctgggtgtgtggtttgctgacctttcagctctgcaggaaggagatcccagctgtcctttggtcctcccttctgcagcacacgacagtcatgtccagtgttgactcctttctcgtttgcaactccgtacaaatgcctggtctcctttttgtaaactttcatatttttgcagacaaatacttttggtacttactctttgagaccattctcacatgtatgtacagtaatcatttttgatgcttttcaacattggttgttttctatttgatatttctcattttcctatatttgtgtttgtatgttatgtgttcatgtaaatttggtatagtaatttttattcaaatatttattgttcacctgttaatgtgccatgaacttccttaacttttgggtgaaggtgaacaagatagctatagttcctgcctttgctaagagcagttggtttaacccatactcaagtgtctgcataggaggtaaacagggtatactttgagaatggcagagacgatgcttttggtaggatattaggaaggcatctggagagtgatgtgtaagctaacccctgacctaggaagagaaagccatgtgaagagccaagggcaatttaacactgctggaacattatcagcatccaaaggctcaggctcatagagactcactgtcaggtatcatgattgtgcacacacctgcacacacccacacgtggtgatgaaaatgcttgttcagtttagaatttgttgaaggtgggactgctttgtgacaggctgcttctgtcatctcactgtaatctattcctcagaccttgtacagctttcttacaccaggtcagtgccacttaatttaacaactcccgttacgtaaatgctcaccagtctggagcctccctgcttgcttctggacgtgttgctgcatatcggctatcactgcttcccttccgctgcccatcttgtgatagagcaattgtcctgtgcattattgctgttgagcctactggagatccttgtacataaactgccccttctctggaagtttccacagactagaaaacttgagctgttgggacagttctggggcagaggacagctttgaaagtggtaggaggttatcagacatgttaaagtgttgccaacagtgagacacagctccatggttggggttcaggaataggttttctataccaccgagcgtgaacaagtcaccgtgtaaactcatgtgaaaagaattcagtgcttatctttgcttttcaccggaatgctgtgggcatgcgctactgtcacctagattttgttgatttcacctcttttgcaagactgatttttgttccagatgattcctacggcctctcttggttgatttatattgatttaatttctccacattatttagcatcatgtctcagcagtaatttgaaagcctttctaccagattcaaacatttggttgtattaggccagtcttttggaatgccactaaactgggctgtgacttaaggaccctttcctgctagggtctgagccacaccagttagacttactatccatcgttatatacatttagtcagcatagttcctgcctattgtttacccagccaatgtgattctgggaccatgtcctggctctggagttgggcttagtcctgtgagagttcctgttgttttcagggcctatgactttgccagaaggaatttgcatatgttttcttgagagctgaatcttctaattgtgtacatatatgtatgtatatgtacagagttccttctttgtttctttaatttcaccttcatcacgccttggttgtcagttcatcccgactaagagtccaagtcagtcaggttagtaggcttttgctggttgaagtcaaagaaagcagatgcccagttgccttccctacctctgccaagagctgcccgtatgtgtttttaagccctccccctttttttaagattaactacttggaacagttgttctcttaggtgtcctctttgctggagagtagttgatttggtggtgaggtataaagtaaggagacaatctaagttgacccttccagcttgcctgtgtgttgcacctctctgtgcaactatctcaggtatgtcttcacagggcagccaagggcctttccccatactgtggcttaaggctttggtgtcctgatagatcagacttattacttgtcatgcttttgcctgagcactttgctaaacccaggcttccttgcaccttaccctccccagtcaatcagctctatttttttttctgaatgcattctgtattcttcccttagtgcgatgcatttccctgcaggcaagctagtattgttcattcctggaccgttgttggagtctttcaaatgactctggaatttttgcccagttaaaatgtccctgtgactgacaagtagcaaactcaacattatttatcatagtttagatggtaacagcatctccatcacagtttggggacagtctagatcagcggtgtgaccctttagtgcagttcctcatgttgtggtgacccccagccataaaattattttattgctacttcattactgtaattttgctactgttatgaatcataatgtaaatatctttgatttttgatggtcttaggtgacccctgtgaaaaggttgtttgaccacccctcccccaaggggttgcaacccacaggttgagaaaccactgttgtaaagtgtccgatttattccagtgatggtggtctgtggtctgcagaggtagacctctgccattggctcctcttctgttttccagcttgcttgattattttacttgttcagactaccttttgtccagggagattgagggacaagttatttcttggattatagtttatgtgtttaaatacttggagccagaaaatgctgagttaatctcatgagtgcttttgcgataagaattggcctcatgtgttatatcttgaatagagacttttaccttggccattataggtagcttatatacatgagagttgcctcaaacattttagttttagtgtatatgtgtgtgtgtgttcaagtgtacacacatgtaccctcagaaaacaaacggtggggttatcttaacaatgatgaaagatacattgtttaaatctcagatctcagtaaagagatcccatttgcttgtagactcatgacacaatcagtgtatttaaaatgaaattaccagtccttatttgacagtgcagctggtatgctggtgttcgggcactggtgaaaatcataagaaatcaattaccgccaataaagctttccatatacctcatccctaaactacacccagcactgagggttaacttgaaaatctgtctcttcttcatttgggtctccccatgaaattccagagacccgggaagtacctccatgaagtcagagtcccacacctaatgctactctaaaggaaggtagttcaggcctgtcttggcagtgaactaccaagaaatgattttccaagacttcttagaacctctgtatactaaccacctatgtgttcattggctagcttctgagtcttagagtggaccccaggtttcacaaatgctagagatgtaggatcccttgggaaaaggggtgttttttggtttgctattttgggatggaaggtaaggatttgtaccttttttctgtcttgaagtaatttttaaacaaccaaatacgcaacataagaacagatacaaagctttagcgtgttggaaaacgctctgattagtgtacaacttccaaaccagctgttacccttcctctctctggctttaaggttcctggctggttgcagtggtaaacactaagtaactttatgtttctaaggctgtattaaattgtgcccttcacagtgttgtgtcatagggggttggctttggggagctgagaagaaacctgccttgaagggccagtgcctagctggttgcacatttgtccttgcctctgtagggtggtggattattggcttatagaggtagtttacagagactggtttaaatcacgagaataactaaccaacccctggcctctgaaccatgtatgtacatataccgatccagcctatttcttggtaaaatgcagaattcaaattgggcacacattagaccagctttaccttcgacttcatttacgcttttattgactctgacataaggtgtgagtatttgactttctttgttggtggcagtgatctgtaacactcagcactttctaggtgagctaaaccaagaaaatccacagtgactggctaaggctgcaacttcattggaaggcaagtgaaaaagcatcagaggcctcctgcctcaaggctggcctcctgggagctcagtacacagtagtgtggctctgggcctctgcaagggccttcaagcttggctgtcctcatacacgaaattagaatgtgggagtagttggcgttgaaggtcttcacatttaaagggatataaaacgatacatgaaactagaatattcatttagctcagaaaatctcaacacgtggtaggtaagatgctatgtaacttacgggaacaggagactcgggacgtcttgtctgaaagtgggtttcaagagtgaagtctgatacactaccactaaatgtacttggtctgagttaaataaccttaaggtatttcccagcttccagctggttagcctttagcaagagagctacaagtgcattgtccttaaggagccttatgtacacagacgttcttttctctgcacgtgtcaagggaaggtgaccagtcccagccatgcctgggacaagggtcccagatatgcaatgctaagtgccaaccaaagtgagtcctaggggtcctgggaggagttgtccccttaggtgtcctcaggacttattctcatactgatgtcatcctagctgataactgtgttgggttatgccatggctgtcaatatttttaggactcaacccctgtattctgtattcattactgtggatgcaacctaagatttacaataaataacacaaagaacaatggagttgagtatggaatgaaaagaggcaacgagctagggatgatctgtgtaggtgtaagtacactttgtgtccttaggagttcttgtaacagaaaccgtgtgaaactatagatgtcttctcctataagggaaaacatggtgtttgatgctttggtctctatttcccagtctgtcctgcttaagaagccagaatgtggtttctatttggtggatgctgtcttaaaattactaaatgtgtcatccggaagcaggtaaaggagtcagtatccctgtggagttctgtcctactctcacggtgcttaccagctaagctgagctcaggagccaagggaaaccctgctcctgctctctggtggtcctcagtggctgatgcagtgcactgtgatggagatactaaaacaagtgtgttatttgtaagtcttctctcagtgattgtcagacaactgtggtgtgtgtgtgtgtgtgtgtgtgtgtgtgtgtgtgtgtgtgagaaacagtgagctgaggctttattatagctgatttccagttaaaattgtgaaatacgtatttcttgtccacaccaaatatttcagtctatttaatgtattaaagaaatagttctgcttaagaaaatgttgcttaaatgttctgtgatttctggtgcatttttatacagatctgtgtgtgtctgtgcattcactttctgcctttgctctctgtgttaactgtcctgttgccctcggaaggtggacactattcgtagcattaaaaagaaatatttgagttatttaccatgtc

SEQ ID NO: 8 - protein, 467 aa, Mus musculus
MSSILPFTPPVVKRLLGWKKSAGGSGGAGGGEQNGQEEKWCEKAVKSLVKKLKKTGRLDELEKAITTQNCNTKCVTIPSTCSEIWGLSTANTVDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 9 - DNA, 8378 bp, Mus musculus
atttaccgggctttttctgagtgtggattgttacctttggtaagaaaatgtcgtccatcttgccattcactccgccagtggtgaagagacttctgggatggaaaaaatcagccggtgggtctggaggagcaggtggtggagagcagaatggacaggaagaaaagtggtgtgaaaaagcagtgaaaagtctggtgaaaaagctaaagaaaacaggacggttagatgagcttgagaaagccatcaccactcagaattgcaatactaaatgtgtcaccataccaaggtctcttgatggccgtcttcaggtttcacaccggaaagggttgccacatgttatatattgccggctctggcgctggccggaccttcacagtcatcatgagctcaaggcaatcgaaaactgcgaatatgcttttaatctgaaaaaagatgaagtgtgtgtaaatccgtaccactaccagagagttgagaccccagtcttgcctccagtcttagtgcctcggcacacggagattctaacagaactgccgcccctggatgactacacccactccattccagaaaacacaaatttcccagcaggaattgagccacagagtaattacatcccagaaacaccaccacctggatatatcagtgaagatggagaaacaagtgaccaacagttgaaccaaagtatggacacaggctctccggctgaactgtctcctactactctctctcctgttaatcacagcttggatttgcagccagttacttactcggaacctgcattctggtgttcaatcgcatactatgaactaaaccagagggttggagagaccttccatgcgtcacagccctcgctcactgtagacggcttcacagacccatcaaactcggagaggttctgcttaggcttgctctccaacgttaaccgaaatgccactgtagaaatgacaagaagacatataggaaggggagtgcgcttgtattacataggtggggaagtgtttgctgagtgcctaagtgatagtgcaatctttgtgcagagccccaactgtaaccagagatacggctggcaccctgcaacagtgtgtaagatcccaccaggctgtaacctgaagatcttcaacaaccaagaatttgctgctcttctggctcagtctgtcaaccagggttttgaagccgtttatcagctaacccgaatgtgcaccataagaatgagttttgtgaagggctggggagcagaatatcggaggcagacagtaacaagtactccttgctggattgaacttcatctgaatggccctctgcagtggctggacaaagtattaactcagatgggatccccttcagtgcgatgctcaagcatgtcgtaaacccatcaaagactcgctgtaacagctcctccgtcgtagtattcatgtatgatcccgtggactgtttgctatccaaaaattccagagcaaaaacagcacttgaggtctcatcagttaaagcaccttgtggaatctgtttcctatatttgaatattagatgggaaaattagtgtctagaaatgccctccccagcggggaaaaagaagacttaaagacttaatgatgtcttgttgggcataagacagtatcccaaaggttattaataacagtagtagttgtgtacaggtaatgtgtccagacccagtattgcagtactatgctgtttgtatacattcttagtttgcataaatgaggtgtgtgtgctgcttcttggtctaggcaagcctttataaaattacagtatctaatctgttattcccacttctccgttatttttgtgtcttttttaatatataatatatatatatcaagattttcaaattatcatttagaagcagattttccttgtagaaactaatttttctgccttttaccaaaaataaacaaactcttgggggaagacaagtggattaacttggaagtccttgaccttcatgtgtccagtggatcttagcagtcgttcttttgtgagccttttctcctgagttgcattagaaggaaaccttactggaaccgtccaggctcctcatcccattcctgttctggttcagagcagtacagcagaatgacgtcgtgctaaacagttgcactgctggcttctgggttagttgtttctgagtccaggaaaggtttgtgtgggcagtaagtccttttgtctaataaccagacttcagcagatgataactgatgtgtataaccagttgttctgttgattaacttttgtctcaaacatgcacaggtggcagtataattattttcagggctattctagaatcatctcagtctgtttccttcttccaaagccagtctaataataaagtacctttctgtaaaggcagccgaccttttgcctcattttacttttactaccaggttgtattacagaacagaccttttgtaaatgtgttagagtgacgctgaggtcttgtcagcagatagggccatctgtttttaaagtgtattgtatgtaatttataagtagaatgttattttacctagcttcaaaggtttaaatattgtgagctaagccatttagcaagatttctagcccgcagttagctgtggacttagctcttcctgacttaccctgggtgtgtggtttgctgacctttcagctctgcaggaaggagatcccagctgtcctttggtcctcccttctgcagcacacgacagtcatgtccagtgttgactcctttctcgtttgcaactccgtacaaatgcctggtctcctttttgtaaactttcatatttttgcagacaaatacttttggtacttactctttgagaccattctcacatgtatgtacagtaatcatttttgatgcttttcaacattggttgttttctatttgatatttctcattttcctatatttgtgtttgtatgttatgtgttcatgtaaatttggtatagtaatttttattcaaatatttattgttcacctgttaatgtgccatgaacttccttaacttttgggtgaaggtgaacaagatagctatagttcctgcctttgctaagagcagttggtttaacccatactcaagtgtctgcataggaggtaaacagggtatactttgagaatggcagagacgatgcttttggtaggatattaggaaggcatctggagagtgatgtgtaagctaacccctgacctaggaagagaaagccatgtgaagagccaagggcaatttaacactgctggaacattatcagcatccaaaggctcaggctcatagagactcactgtcaggtatcatgattgtgcacacacctgcacacacccacacgtggtgatgaaaatgcttgttcagtttagaatttgttgaaggtgggactgctttgtgacaggctgcttctgtcatctcactgtaatctattcctcagaccttgtacagctttcttacaccaggtcagtgccacttaatttaacaactcccgttacgtaaatgctcaccagtctggagcctccctgcttgcttctggacgtgttgctgcatatcggctatcactgcttcccttccgctgcccatcttgtgatagagcaattgtcctgtgcattattgctgttgagcctactggagatccttgtacataaactgccccttctctggaagtttccacagactagaaaacttgagctgttgggacagttctggggcagaggacagctttgaaagtggtaggaggttatcagacatgttaaagtgttgccaacagtgagacacagctccatggttggggttcaggaataggttttctataccaccgagcgtgaacaagtcaccgtgtaaactcatgtgaaaagaattcagtgcttatctttgcttttcaccggaatgctgtgggcatgcgctactgtcacctagattttgttgatttcacctcttttgcaagactgatttttgttccagatgattcctacggcctctcttggttgatttatattgatttaatttctccacattatttagcatcatgtctcagcagtaatttgaaagcctttctaccagattcaaacatttggttgtattaggccagtcttttggaatgccactaaactgggctgtgacttaaggaccctttcctgctagggtctgagccacaccagttagacttactatccatcgttatatacatttagtcagcatagttcctgcctattgtttacccagccaatgtgattctgggaccatgtcctggctctggagttgggcttagtcctgtgagagttcctgttgttttcagggcctatgactttgccagaaggaatttgcatatgttttcttgagagctgaatcttctaattgtgtacatatatgtatgtatatgtacagagttccttctttgtttctttaatttcaccttcatcacgccttggttgtcagttcatcccgactaagagtccaagtcagtcaggttagtaggcttttgctggttgaagtcaaagaaagcagatgcccagttgccttccctacctctgccaagagctgcccgtatgtgtttttaagccctccccctttttttaagattaactacttggaacagttgttctcttaggtgtcctctttgctggagagtagttgatttggtggtgaggtataaagtaaggagacaatctaagttgacccttccagcttgcctgtgtgttgcacctctctgtgcaactatctcaggtatgtcttcacagggcagccaagggcctttccccatactgtggcttaaggctttggtgtcctgatagatcagacttattacttgtcatgcttttgcctgagcactttgctaaacccaggcttccttgcaccttaccctccccagtcaatcagctctatttttttttctgaatgcattctgtattcttcccttagtgcgatgcatttccctgcaggcaagctagtattgttcattcctggaccgttgttggagtctttcaaatgactctggaatttttgcccagttaaaatgtccctgtgactgacaagtagcaaactcaacattatttatcatagtttagatggtaacagcatctccatcacagtttggggacagtctagatcagcggtgtgaccctttagtgcagttcctcatgttgtggtgacccccagccataaaattattttattgctacttcattactgtaattttgctactgttatgaatcataatgtaaatatctttgatttttgatggtcttaggtgacccctgtgaaaaggttgtttgaccacccctcccccaaggggttgcaacccacaggttgagaaaccactgttgtaaagtgtccgatttattccagtgatggtggtctgtggtctgcagaggtagacctctgccattggctcctcttctgttttccagcttgcttgattattttacttgttcagactaccttttgtccagggagattgagggacaagttatttcttggattatagtttatgtgtttaaatacttggagccagaaaatgctgagttaatctcatgagtgcttttgcgataagaattggcctcatgtgttatatcttgaatagagacttttaccttggccattataggtagcttatatacatgagagttgcctcaaacattttagttttagtgtatatgtgtgtgtgtgttcaagtgtacacacatgtaccctcagaaaacaaacggtggggttatcttaacaatgatgaaagatacattgtttaaatctcagatctcagtaaagagatcccatttgcttgtagactcatgacacaatcagtgtatttaaaatgaaattaccagtccttatttgacagtgcagctggtatgctggtgttcgggcactggtgaaaatcataagaaatcaattaccgccaataaagctttccatatacctcatccctaaactacacccagcactgagggttaacttgaaaatctgtctcttcttcatttgggtctccccatgaaattccagagacccgggaagtacctccatgaagtcagagtcccacacctaatgctactctaaaggaaggtagttcaggcctgtcttggcagtgaactaccaagaaatgattttccaagacttcttagaacctctgtatactaaccacctatgtgttcattggctagcttctgagtcttagagtggaccccaggtttcacaaatgctagagatgtaggatcccttgggaaaaggggtgttttttggtttgctattttgggatggaaggtaaggatttgtaccttttttctgtcttgaagtaatttttaaacaaccaaatacgcaacataagaacagatacaaagctttagcgtgttggaaaacgctctgattagtgtacaacttccaaaccagctgttacccttcctctctctggctttaaggttcctggctggttgcagtggtaaacactaagtaactttatgtttctaaggctgtattaaattgtgcccttcacagtgttgtgtcatagggggttggctttggggagctgagaagaaacctgccttgaagggccagtgcctagctggttgcacatttgtccttgcctctgtagggtggtggattattggcttatagaggtagtttacagagactggtttaaatcacgagaataactaaccaacccctggcctctgaaccatgtatgtacatataccgatccagcctatttcttggtaaaatgcagaattcaaattgggcacacattagaccagctttaccttcgacttcatttacgcttttattgactctgacataaggtgtgagtatttgactttctttgttggtggcagtgatctgtaacactcagcactttctaggtgagctaaaccaagaaaatccacagtgactggctaaggctgcaacttcattggaaggcaagtgaaaaagcatcagaggcctcctgcctcaaggctggcctcctgggagctcagtacacagtagtgtggctctgggcctctgcaagggccttcaagcttggctgtcctcatacacgaaattagaatgtgggagtagttggcgttgaaggtcttcacatttaaagggatataaaacgatacatgaaactagaatattcatttagctcagaaaatctcaacacgtggtaggtaagatgctatgtaacttacgggaacaggagactcgggacgtcttgtctgaaagtgggtttcaagagtgaagtctgatacactaccactaaatgtacttggtctgagttaaataaccttaaggtatttcccagcttccagctggttagcctttagcaagagagctacaagtgcattgtccttaaggagccttatgtacacagacgttcttttctctgcacgtgtcaagggaaggtgaccagtcccagccatgcctgggacaagggtcccagatatgcaatgctaagtgccaaccaaagtgagtcctaggggtcctgggaggagttgtccccttaggtgtcctcaggacttattctcatactgatgtcatcctagctgataactgtgttgggttatgccatggctgtcaatatttttaggactcaacccctgtattctgtattcattactgtggatgcaacctaagatttacaataaataacacaaagaacaatggagttgagtatggaatgaaaagaggcaacgagctagggatgatctgtgtaggtgtaagtacactttgtgtccttaggagttcttgtaacagaaaccgtgtgaaactatagatgtcttctcctataagggaaaacatggtgtttgatgctttggtctctatttcccagtctgtcctgcttaagaagccagaatgtggtttctatttggtggatgctgtcttaaaattactaaatgtgtcatccggaagcaggtaaaggagtcagtatccctgtggagttctgtcctactctcacggtgcttaccagctaagctgagctcaggagccaagggaaaccctgctcctgctctctggtggtcctcagtggctgatgcagtgcactgtgatggagatactaaaacaagtgtgttatttgtaagtcttctctcagtgattgtcagacaactgtggtgtgtgtgtgtgtgtgtgtgtgtgtgtgtgtgtgtgtgtgagaaacagtgagctgaggctttattatagctgatttccagttaaaattgtgaaatacgtatttcttgtccacaccaaatatttcagtctatttaatgtattaaagaaatagttctgcttaagaaaatgttgcttaaatgttctgtgatttctggtgcatttttatacagatctgtgtgtgtctgtgcattcactttctgcctttgctctctgtgttaactgtcctgttgccctcggaaggtggacactattcgtagcattaaaaagaaatatttgagttatttaccatgtc

SEQ ID NO: 10 - protein, 437 aa, Mus musculus; identical to SEQ ID NO: 4

SEQ ID NO: 11 - DNA, 8752 bp, Mus musculus
cgccccgctcggcccccggccctgcccgcggcgcccggcctccttccgtccctgccgtgctccctccgtcttccgtgcgcgcccgctcggccggcgtgcctcacgcctaacgggcggccgcgggcgccaatcagcgggcggcagggtgccagcccggggctgcgccggcgaatcggcggggtccgcggctcggggagggaggcggggctaccgcgcgcggcggtggaggagcagctcgccaagcctgcagctcgcgagcgccgagcgagcctcccggagggtagatttaccgggctttttctgagtgtggattgttacctttggtaagaaaatgtcgtccatcttgccattcactccgccagtggtgaagagacttctgggatggaaaaaatcagccggtgggtctggaggagcaggtggtggagagcagaatggacaggaagaaaagtggtgtgaaaaagcagtgaaaagtctggtgaaaaagctaaagaaaacaggacggttagatgagcttgagaaagccatcaccactcagaattgcaatactaaatgtgtcaccataccaagcacttgctctgaaatttggggactgagtacagcaaatacggtagatcagtgggacacaacaggcctttacagcttctctgaacaaaccaggtctcttgatggccgtcttcaggtttcacaccggaaagggttgccacatgttatatattgccggctctggcgctggccggaccttcacagtcatcatgagctcaaggcaatcgaaaactgcgaatatgcttttaatctgaaaaaagatgaagtgtgtgtaaatccgtaccactaccagagagttgagaccccagtcttgcctccagtcttagtgcctcggcacacggagattctaacagaactgccgcccctggatgactacacccactccattccagaaaacacaaatttcccagcaggaattgagccacagagtaattacatcccagaaacaccaccacctggatatatcagtgaagatggagaaacaagtgaccaacagttgaaccaaagtatggacacaggctctccggctgaactgtctcctactactctctctcctgttaatcacagcttggatttgcagccagttacttactcggaacctgcattctggtgttcaatcgcatactatgaactaaaccagagggttggagagaccttccatgcgtcacagccctcgctcactgtagacggcttcacagacccatcaaactcggagaggttctgcttaggcttgctctccaacgttaaccgaaatgccactgtagaaatgacaagaagacatataggaaggggagtgcgcttgtattacataggtggggaagtgtttgctgagtgcctaagtgatagtgcaatctttgtgcagagccccaactgtaaccagagatacggctggcaccctgcaacagtgtgtaagatcccaccaggctgtaacctgaagatcttcaacaaccaagaatttgctgctcttctggctcagtctgtcaaccagggttttgaagccgtttatcagctaacccgaatgtgcaccataagaatgagttttgtgaagggctggggagcagaatatcggaggcagacagtaacaagtactccttgctggattgaacttcatctgaatggccctctgcagtggctggacaaagtattaactcagatgggatccccttcagtgcgatgctcaagcatgtcgtaaacccatcaaagactcgctgtaacagctcctccgtcgtagtattcatgtatgatcccgtggactgtttgctatccaaaaattccagagcaaaaacagcacttgaggtctcatcagttaaagcaccttgtggaatctgtttcctatatttgaatattagatgggaaaattagtgtctagaaatgccctccccagcggggaaaaagaagacttaaagacttaatgatgtcttgttgggcataagacagtatcccaaaggttattaataacagtagtagttgtgtacaggtaatgtgtccagacccagtattgcagtactatgctgtttgtatacattcttagtttgcataaatgaggtgtgtgtgctgcttcttggtctaggcaagcctttataaaattacagtatctaatctgttattcccacttctccgttatttttgtgtcttttttaatatataatatatatatatcaagattttcaaattatcatttagaagcagattttccttgtagaaactaatttttctgccttttaccaaaaataaacaaactcttgggggaagacaagtggattaacttggaagtccttgaccttcatgtgtccagtggatcttagcagtcgttcttttgtgagccttttctcctgagttgcattagaaggaaaccttactggaaccgtccaggctcctcatcccattcctgttctggttcagagcagtacagcagaatgacgtcgtgctaaacagttgcactgctggcttctgggttagttgtttctgagtccaggaaaggtttgtgtgggcagtaagtccttttgtctaataaccagacttcagcagatgataactgatgtgtataaccagttgttctgttgattaacttttgtctcaaacatgcacaggtggcagtataattattttcagggctattctagaatcatctcagtctgtttccttcttccaaagccagtctaataataaagtacctttctgtaaaggcagccgaccttttgcctcattttacttttactaccaggttgtattacagaacagaccttttgtaaatgtgttagagtgacgctgaggtcttgtcagcagatagggccatctgtttttaaagtgtattgtatgtaatttataagtagaatgttattttacctagcttcaaaggtttaaatattgtgagctaagccatttagcaagatttctagcccgcagttagctgtggacttagctcttcctgacttaccctgggtgtgtggtttgctgacctttcagctctgcaggaaggagatcccagctgtcctttggtcctcccttctgcagcacacgacagtcatgtccagtgttgactcctttctcgtttgcaactccgtacaaatgcctggtctcctttttgtaaactttcatatttttgcagacaaatacttttggtacttactctttgagaccattctcacatgtatgtacagtaatcatttttgatgcttttcaacattggttgttttctatttgatatttctcattttcctatatttgtgtttgtatgttatgtgttcatgtaaatttggtatagtaatttttattcaaatatttattgttcacctgttaatgtgccatgaacttccttaacttttgggtgaaggtgaacaagatagctatagttcctgcctttgctaagagcagttggtttaacccatactcaagtgtctgcataggaggtaaacagggtatactttgagaatggcagagacgatgcttttggtaggatattaggaaggcatctggagagtgatgtgtaagctaacccctgacctaggaagagaaagccatgtgaagagccaagggcaatttaacactgctggaacattatcagcatccaaaggctcaggctcatagagactcactgtcaggtatcatgattgtgcacacacctgcacacacccacacgtggtgatgaaaatgcttgttcagtttagaatttgttgaaggtgggactgctttgtgacaggctgcttctgtcatctcactgtaatctattcctcagaccttgtacagctttcttacaccaggtcagtgccacttaatttaacaactcccgttacgtaaatgctcaccagtctggagcctccctgcttgcttctggacgtgttgctgcatatcggctatcactgcttcccttccgctgcccatcttgtgatagagcaattgtcctgtgcattattgctgttgagcctactggagatccttgtacataaactgccccttctctggaagtttccacagactagaaaacttgagctgttgggacagttctggggcagaggacagctttgaaagtggtaggaggttatcagacatgttaaagtgttgccaacagtgagacacagctccatggttggggttcaggaataggttttctataccaccgagcgtgaacaagtcaccgtgtaaactcatgtgaaaagaattcagtgcttatctttgcttttcaccggaatgctgtgggcatgcgctactgtcacctagattttgttgatttcacctcttttgcaagactgatttttgttccagatgattcctacggcctctcttggttgatttatattgatttaatttctccacattatttagcatcatgtctcagcagtaatttgaaagcctttctaccagattcaaacatttggttgtattaggccagtcttttggaatgccactaaactgggctgtgacttaaggaccctttcctgctagggtctgagccacaccagttagacttactatccatcgttatatacatttagtcagcatagttcctgcctattgtttacccagccaatgtgattctgggaccatgtcctggctctggagttgggcttagtcctgtgagagttcctgttgttttcagggcctatgactttgccagaaggaatttgcatatgttttcttgagagctgaatcttctaattgtgtacatatatgtatgtatatgtacagagttccttctttgtttctttaatttcaccttcatcacgccttggttgtcagttcatcccgactaagagtccaagtcagtcaggttagtaggcttttgctggttgaagtcaaagaaagcagatgcccagttgccttccctacctctgccaagagctgcccgtatgtgtttttaagccctccccctttttttaagattaactacttggaacagttgttctcttaggtgtcctctttgctggagagtagttgatttggtggtgaggtataaagtaaggagacaatctaagttgacccttccagcttgcctgtgtgttgcacctctctgtgcaactatctcaggtatgtcttcacagggcagccaagggcctttccccatactgtggcttaaggctttggtgtcctgatagatcagacttattacttgtcatgcttttgcctgagcactttgctaaacccaggcttccttgcaccttaccctccccagtcaatcagctctatttttttttctgaatgcattctgtattcttcccttagtgcgatgcatttccctgcaggcaagctagtattgttcattcctggaccgttgttggagtctttcaaatgactctggaatttttgcccagttaaaatgtccctgtgactgacaagtagcaaactcaacattatttatcatagtttagatggtaacagcatctccatcacagtttggggacagtctagatcagcggtgtgaccctttagtgcagttcctcatgttgtggtgacccccagccataaaattattttattgctacttcattactgtaattttgctactgttatgaatcataatgtaaatatctttgatttttgatggtcttaggtgacccctgtgaaaaggttgtttgaccacccctcccccaaggggttgcaacccacaggttgagaaaccactgttgtaaagtgtccgatttattccagtgatggtggtctgtggtctgcagaggtagacctctgccattggctcctcttctgttttccagcttgcttgattattttacttgttcagactaccttttgtccagggagattgagggacaagttatttcttggattatagtttatgtgtttaaatacttggagccagaaaatgctgagttaatctcatgagtgcttttgcgataagaattggcctcatgtgttatatcttgaatagagacttttaccttggccattataggtagcttatatacatgagagttgcctcaaacattttagttttagtgtatatgtgtgtgtgtgttcaagtgtacacacatgtaccctcagaaaacaaacggtggggttatcttaacaatgatgaaagatacattgtttaaatctcagatctcagtaaagagatcccatttgcttgtagactcatgacacaatcagtgtatttaaaatgaaattaccagtccttatttgacagtgcagctggtatgctggtgttcgggcactggtgaaaatcataagaaatcaattaccgccaataaagctttccatatacctcatccctaaactacacccagcactgagggttaacttgaaaatctgtctcttcttcatttgggtctccccatgaaattccagagacccgggaagtacctccatgaagtcagagtcccacacctaatgctactctaaaggaaggtagttcaggcctgtcttggcagtgaactaccaagaaatgattttccaagacttcttagaacctctgtatactaaccacctatgtgttcattggctagcttctgagtcttagagtggaccccaggtttcacaaatgctagagatgtaggatcccttgggaaaaggggtgttttttggtttgctattttgggatggaaggtaaggatttgtaccttttttctgtcttgaagtaatttttaaacaaccaaatacgcaacataagaacagatacaaagctttagcgtgttggaaaacgctctgattagtgtacaacttccaaaccagctgttacccttcctctctctggctttaaggttcctggctggttgcagtggtaaacactaagtaactttatgtttctaaggctgtattaaattgtgcccttcacagtgttgtgtcatagggggttggctttggggagctgagaagaaacctgccttgaagggccagtgcctagctggttgcacatttgtccttgcctctgtagggtggtggattattggcttatagaggtagtttacagagactggtttaaatcacgagaataactaaccaacccctggcctctgaaccatgtatgtacatataccgatccagcctatttcttggtaaaatgcagaattcaaattgggcacacattagaccagctttaccttcgacttcatttacgcttttattgactctgacataaggtgtgagtatttgactttctttgttggtggcagtgatctgtaacactcagcactttctaggtgagctaaaccaagaaaatccacagtgactggctaaggctgcaacttcattggaaggcaagtgaaaaagcatcagaggcctcctgcctcaaggctggcctcctgggagctcagtacacagtagtgtggctctgggcctctgcaagggccttcaagcttggctgtcctcatacacgaaattagaatgtgggagtagttggcgttgaaggtcttcacatttaaagggatataaaacgatacatgaaactagaatattcatttagctcagaaaatctcaacacgtggtaggtaagatgctatgtaacttacgggaacaggagactcgggacgtcttgtctgaaagtgggtttcaagagtgaagtctgatacactaccactaaatgtacttggtctgagttaaataaccttaaggtatttcccagcttccagctggttagcctttagcaagagagctacaagtgcattgtccttaaggagccttatgtacacagacgttcttttctctgcacgtgtcaagggaaggtgaccagtcccagccatgcctgggacaagggtcccagatatgcaatgctaagtgccaaccaaagtgagtcctaggggtcctgggaggagttgtccccttaggtgtcctcaggacttattctcatactgatgtcatcctagctgataactgtgttgggttatgccatggctgtcaatatttttaggactcaacccctgtattctgtattcattactgtggatgcaacctaagatttacaataaataacacaaagaacaatggagttgagtatggaatgaaaagaggcaacgagctagggatgatctgtgtaggtgtaagtacactttgtgtccttaggagttcttgtaacagaaaccgtgtgaaactatagatgtcttctcctataagggaaaacatggtgtttgatgctttggtctctatttcccagtctgtcctgcttaagaagccagaatgtggtttctatttggtggatgctgtcttaaaattactaaatgtgtcatccggaagcaggtaaaggagtcagtatccctgtggagttctgtcctactctcacggtgcttaccagctaagctgagctcaggagccaagggaaaccctgctcctgctctctggtggtcctcagtggctgatgcagtgcactgtgatggagatactaaaacaagtgtgttatttgtaagtcttctctcagtgattgtcagacaactgtggtgtgtgtgtgtgtgtgtgtgtgtgtgtgtgtgtgtgtgtgagaaacagtgagctgaggctttattatagctgatttccagttaaaattgtgaaatacgtatttcttgtccacaccaaatatttcagtctatttaatgtattaaagaaatagttctgcttaagaaaatgttgcttaaatgttctgtgatttctggtgcatttttatacagatctgtgtgtgtctgtgcattcactttctgcctttgctctctgtgttaactgtcctgttgccctcggaaggtggacactattcgtagcattaaaaagaaatatttgagttatttaccatgtc

SEQ ID NO: 12 - protein, 467 aa, Mus musculus; identical to SEQ ID NO: 8

SEQ ID NO: 13 - DNA, 2598 bp, Rattus norvegicus
gggcgccaatcagcgggcggcagggtgccagcccggggctgcgccggcgaatcggcggggcccgcggctcggggagggaggcggggctaccgcgcgcggcggtggaggagcagctcgctcgcctgcagctcgcgagcgctgagcgagccgcccgaagggtagatttaccaggctgtttctgagtgtggattgttacccttggtaagaaaatgtcgtccatcttgccattcactccgccagtggtgaagagacttctgggatggaaaaaatcagccggtgggtctggaggagcaggtggtggagaacagaatggacaggaagaaaagtggtgtgaaaaagcagtgaaaagtctggtgaaaaagctaaagaaaacaggacgattagatgagcttgagaaagccatcaccactcagaattgcaatactaagtgtgtcaccataccaagcacttgctctgaaatttggggactgagtacagcaaatacggtagatcagtgggacacaacaggcctttacagcttctctgaacaaaccaggtctcttgatggtcgtcttcaggtgtctcatcggaaagggctgccacatgttatatattgccggctgtggcgctggccagaccttcacagccatcatgagctcaaggcgatcgagaactgcgaatacgctttcagtctgaaaaaagatgaagtgtgtgtgaacccttaccactaccagagggtggagacaccagtcttgcctccagtcttggtgcctcggcacacagagattctaacagaactgccgcctctggatgactatacccactccattccagaaaacacaaatttcccagcaggaattgagccacagagtaattacatcccagaaacaccaccacctggatatatcagtgaagatggagaaactagtgaccaacagttgaaccaaagtatggacacaggctctccggctgaactgtctcctaccactctctcccctgtcaatcacagcttggatttgcagccagttacttattcagaacctgcattttggtgttcaatcgcatattatgaactaaaccagagggttggagagaccttccatgcgtcacagccctcactcactgtagacggctttacagatccatcgaactcggagaggttctgcttaggtttgctctccaacgttaacagaaacgctactgtagaaatgaccagaaggcatataggaaggggagtgcgcttgtattacataggtggggaagtgtttgccgagtgcctaagtgatagtgcgatctttgtgcagagccccaactgtaaccagagatacggctggcaccccgcgacagtgtgcaaaatcccaccaggctgtaacctgaagatcttcaacaaccaagaatttgctgctcttctggctcagtctgttaaccagggttttgaggccgtttatcagctgactcgaatgtgcaccataagaatgagcttcgtgaaggggtggggagcagaataccggaggcagacagtaacaagtactccttgctggattgaacttcatctgaatggccccctgcagtggttggacaaagtattaactcagatgggatccccgtcagtgcgatgctcaagcatgtcctaaagtccgtcagcagtggagctcattggaagacttaacgtaccaactcctccgccacagtactcgtgtgtgatcccgtggactgtgctagtcaaaacccagagcgaaaacagcacttgaggtctcatcagttaaagcaccttgtggagtctgtttcctacatttgaattttagatgggaaattagtgtctagaaatgccctccccagaggggacaaagaagacttaaagacttaatgatgtctcgttgggcataagacagtgtcccaaaggttattaataccagtagtagttgtgtacagtaatgtgtccagacccagtattgcagtgctctgctgtttgtataccttcttagtgtgcataaatgaggtgtgtgctgctgcttggtctaggcaagcctttataaaattacagtacctaatctgttattcccacttctccgttatttttgtgtcttttttaatatataatatatatatcgagattttcaaattatcatttagaagcagattttccttgtagaaactaatttttctgccttttaccaaaaataaactcgtgggggaagaaaagtggattaacttggaagtccttgaccttaatgtgtccagtgggtcttagcattctttctgtgatcattttctgctgaattgcattagaaggaaaccttgttggaaacttccaggctctttgtgccatttctgttctgattcaaagcagtgcagcatgatgtcattgtggtaaatagttgcactgatggcttctgggttagttacttctgagtccagtaaaggattgtgtgagcagtaagtccttttgtcttctaaccagacttcagcagatgataaccagttgttccattgattaacttttgtctcaaacgtgcacaggtgacagtataattattttcagggctattctagaatcatctcagtatgtttccttcttccaacgccagtctgataataaagtatctttctgtaaaggca

SEQ ID NO: 14 - protein, 467 aa, Rattus norvegicus
MSSILPFTPPVVKRLLGWKKSAGGSGGAGGGEQNGQEEKWCEKAVKSLVKKLKKTGRLDELEKAITTQNCNTKCVTIPSTCSEIWGLSTANTVDQWDTTGLYSFSEQTRSLDGRLQVSHRKGLPHVIYCRLWRWPDLHSHHELKAIENCEYAFSLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 15 - DNA, 2626 bp, Rattus norvegicus
tggagcaggcggctccctccccagccggccgcggtgagcgcgggcctgggggcggggcgggggcccgcggcgcagttccgcctgcgcgcgcccactcctccggcagcgcggagcccgtcggaagaggaaggaacaaaaggtccggggcccggctcggacgggccgggaccaggcgctgggtgcagggtagatttaccaggctgtttctgagtgtggattgttacccttggtaagaaaatgtcgtccatcttgccattcactccgccagtggtgaagagacttctgggatggaaaaaatcagccggtgggtctggaggagcaggtggtggagaacagaatggacaggaagaaaagtggtgtgaaaaagcagtgaaaagtctggtgaaaaagctaaagaaaacaggacgattagatgagcttgagaaagccatcaccactcagaattgcaatactaagtgtgtcaccataccaagcacttgctctgaaatttggggactgagtacagcaaatacggtagatcagtgggacacaacaggcctttacagcttctctgaacaaaccaggtctcttgatggtcgtcttcaggtgtctcatcggaaagggctgccacatgttatatattgccggctgtggcgctggccagaccttcacagccatcatgagctcaaggcgatcgagaactgcgaatacgctttcagtctgaaaaaagatgaagtgtgtgtgaacccttaccactaccagagggtggagacaccagtcttgcctccagtcttggtgcctcggcacacagagattctaacagaactgccgcctctggatgactatacccactccattccagaaaacacaaatttcccagcaggaattgagccacagagtaattacatcccagaaacaccaccacctggatatatcagtgaagatggagaaactagtgaccaacagttgaaccaaagtatggacacaggctctccggctgaactgtctcctaccactctctcccctgtcaatcacagcttggatttgcagccagttacttattcagaacctgcattttggtgttcaatcgcatattatgaactaaaccagagggttggagagaccttccatgcgtcacagccctcactcactgtagacggctttacagatccatcgaactcggagaggttctgcttaggtttgctctccaacgttaacagaaacgctactgtagaaatgaccagaaggcatataggaaggggagtgcgcttgtattacataggtggggaagtgtttgccgagtgcctaagtgatagtgcgatctttgtgcagagccccaactgtaaccagagatacggctggcaccccgcgacagtgtgcaaaatcccaccaggctgtaacctgaagatcttcaacaaccaagaatttgctgctcttctggctcagtctgttaaccagggttttgaggccgtttatcagctgactcgaatgtgcaccataagaatgagcttcgtgaaggggtggggagcagaataccggaggcagacagtaacaagtactccttgctggattgaacttcatctgaatggccccctgcagtggttggacaaagtattaactcagatgggatccccgtcagtgcgatgctcaagcatgtcctaaagtccgtcagcagtggagctcattggaagacttaacgtaccaactcctccgccacagtactcgtgtgtgatcccgtggactgtgctagtcaaaacccagagcgaaaacagcacttgaggtctcatcagttaaagcaccttgtggagtctgtttcctacatttgaattttagatgggaaattagtgtctagaaatgccctccccagaggggacaaagaagacttaaagacttaatgatgtctcgttgggcataagacagtgtcccaaaggttattaataccagtagtagttgtgtacagtaatgtgtccagacccagtattgcagtgctctgctgtttgtataccttcttagtgtgcataaatgaggtgtgtgctgctgcttggtctaggcaagcctttataaaattacagtacctaatctgttattcccacttctccgttatttttgtgtcttttttaatatataatatatatatcgagattttcaaattatcatttagaagcagattttccttgtagaaactaatttttctgccttttaccaaaaataaactcgtgggggaagaaaagtggattaacttggaagtccttgaccttaatgtgtccagtgggtcttagcattctttctgtgatcattttctgctgaattgcattagaaggaaaccttgttggaaacttccaggctctttgtgccatttctgttctgattcaaagcagtgcagcatgatgtcattgtggtaaatagttgcactgatggcttctgggttagttacttctgagtccagtaaaggattgtgtgagcagtaagtccttttgtcttctaaccagacttcagcagatgataaccagttgttccattgattaacttttgtctcaaacgtgcacaggtgacagtataattattttcagggctattctagaatcatctcagtatgtttccttcttccaacgccagtctgataataaagtatctttctgtaaaggca

SEQ ID NO: 16 - protein, 467 aa, Rattus norvegicus; identical to SEQ ID NO: 14

SEQ ID NO: 17 - DNA, 4944 bp, Homo sapiens
ctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 18 - protein, 680 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 19 - DNA, 4850 bp, Homo sapiens
ctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 20 - protein, 555 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 21 - DNA, 2916 bp, Homo sapiens
ctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttatcttgca

SEQ ID NO: 22 - protein, 487 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 23 - DNA, 4677 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 24 - protein, 586 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 25 - DNA, 4583 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcaggatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 26 - protein, 461 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVRIWQV

SEQ ID NO: 27 - DNA, 2649 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttatcttgca

SEQ ID NO: 28 - protein, 393 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKHLLSACFRNELVEPRRETPKQSDVFFRHSKPPNRSVYP

SEQ ID NO: 29 - DNA, 4705 bp, Homo sapiens
ctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 30 - protein, 510 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 31 - DNA, 4438 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 32 - protein, 416 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 33 - DNA, 4422 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 34 - protein, 501 aa, Homo sapiens
MLYLENNAQTQFSEYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 35 - DNA, 4932 bp, Homo sapiens
ctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 36 - protein, 676 aa, Homo sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 37 - DNA, 4426 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 38 - protein, 412 aa, Homo sapiens
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 39 - DNA, 4171 bp, Homo sapiens
cagagagagaaagagagagagggacttgagttctgttatcttcttaagtagattcatattgtaagggtctcggggtgggggggttggcaaaatcctggagccagaagaaaggacagcagcattgatcaatcttacagctaacatgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatgcgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacagatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaa

SEQ ID NO: 40 - protein, 327 aa, Homo sapiens
MLYLENNAQTQFSEYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDAFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANRSGKSENP

SEQ ID NO: 41 - DNA, 5269 bp, Homo sapiens
ggcaacccgctggggtcaccttccacactgtggaagctttgttcttttgctctttgcagtaaatcttgctactgctcactctttgggtgcacactgcttttatgagctgtaacactcaccgtgaaggtctgcagcttcactcctgaagccagcgagaccaggagtccactgggaggaacgaacaactccagacgcaccgccttaagaacttcaacactcactgcgaaggtctgcagcttcactcctgagccagcgagaccacgaacccaccgtaaggaagaaactccgaacacatccgaacatcagaaggaacaaactccagacgcgccaccttaagagctgtaacactcaccgccagggtccgcggcttcattcttgaagtcagagagaccaagaacccaccaattccggacaccctatcagagattttgaaaactatgaagtgctgggaacagagagactggacagccttcacaaaggtggggaaaccttgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattgaaaaaaaaaaaaaaaaaa

SEQ ID NO: 42 - protein, 678 aa, Homo sapiens
MKCWEQRDWTAFTKVGKPCFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 43 - DNA, 5382 bp, Mus musculus
aaaacattgtagccacagcagaactgacaggagctctcaaatcaagtcagaatacagatacaaggagatgttattcagttggagcaagggggacatttattagctcagtgacaagtcctggcttctgtgattaaactctgatgccattcataccagcacccaatcccaagcaagatcagaagttcagagatgcctacaaattgccaacaagtgtggccactctacgtcaagggctctaaaactgtggcagagaggaagaacagctttacagggggtgcccagctggtaagaattgacggtttatgatgctctggttacttgaagactctcattggctgaaaggaagaaacgccccgcctctttgcaaatctgagtaaaggggggaagtgtctaaacttctatgtctgatggcatttgaccctattgctttcagcctcctggctacatacctagatattctcaggtgtatatgtatattttatagaattgcttcccatctgttggtatcaaagagagttgaaggaaatgaattttgaaacttcacggtgtgccaccctacagtactgccccgacccttacatccagcgtttcatagaaaccccagctcatttctcgtggaaagaaagttattacagatctgccatgtcgcagagcacccagacaagcgagttcctcagcccagaggtcttccagcatatctgggattttctggaacagcctatatgctcagtacagcccatcgagttgaactttgtggatgaaccttccgaaaatggtgcaacaaacaagattgagattagcatggattgtatccgcatgcaagactcagacctcagtgaccccatgtggccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatggtacgaagcgccctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacagacctcgatgcagtctcagtcttcatatggcaacagttccccacctctgaacaaaatgaacagcatgaacaagctgccttccgtgagccagcttatcaacccacagcagcgcaatgccctcactcccaccaccatgcctgagggcatgggagccaacattcctatgatgggcactcacatgccaatggctggagacatgaatggactcagccctacccaagctctccctcctccactctccatgccctccacctcccactgcaccccaccaccgccctaccccacagactgcagcattgtcagtttcttagcaaggttgggctgctcatcatgcctggactatttcacgacccaggggctgaccaccatctatcagattgagcattactccatggatgatttggcaagtctgaagatccctgaacagttccgacatgccatctggaagggcatcctggaccacaggcagctgcacgacttctcctcacctcctcatctcctgaggaccccaagtggtgcctctaccgtcagtgtgggctccagtgagacccgtggtgaacgtgtgatcgatgccgtgcgctttaccctccgccagaccatctcttttccaccccgtgacgagtggaatgatttcaactttgacatggattctcgtcgcaacaagcagcagcgtatcaaagaggaaggagaatgagcgcccattgcggggttcttcctgtcttcttccacctcccagcccctacagggcacgcctgcttgatcctcagagccttctcgttagctcttctccttctccttctcagtctggtttctaaagggacggagaattaggaggctgcctgttacctaaagtctgacctgtcacctgattctgattctggctttaagccttcaatactcttgcttgcaagatgcattgacattgctagatagaagttagcaaagaagcagtaggtctctttaagcagtggagatctctcattgacttttataaagcattttcagccttatagtctaagactatatatataaatatataaatatccgatatatattttgggtgtggggggtattgagtattgtttaaatgtaatttaatggaaattgagttgcacttatcatccttctttggaatttgcttgtttcggatggctgagctgtactcctttctcaggggtatcatgtatggtgacagatatctagagttgaatggtctatgtgagtaacaatgacgtataggacctctcctcatcctttggatggttattgtttagcacatcaaacctgtggatgcatccagtgtgtttaccattgcttcctatgaggtaaaactgtatatatgtacacagttttctctgtcagtatattttatgttactggtgtccattccagttaggctggttcactctgtggctattacaagccacattttaggtttgctttgtcacacactataagacagggcattgtctcttgcttttgtttgagaatgaggaatgcagttgtgttgtggtttgttttgttttattttgttttgttttctggaaactcttaaatggttcaagtcagccattccaaatatctgatgaaatttagcccaatatagcagtagctctttgaaatttaaggcccaacaccctagtatttattagaaaaataaacatttgctgttgttagaatagtcttaaaaataaatttctctgctagattgactaagtaaaatagacattctctgctgttgtgagaatttgggccaattagaatgaatgaaattcgtctagttttcatggggagttgtaatgtctattagaaagattcaggaaaaataagaatgattcagaaatactgaatttccatgaaaaggaaaacagaaagcgattcatcccaccaaactctgaattgaagttccttttgaagggtggagtgatgcttgggaagtggaccttttaaagactttcctatctatgagacactgcatgcacaggcaagtttctctctccccaagggctaaaataagaataatggcttggaaaatacaaacttcgtagtgtagttttcacatagcatgagctgaaccactgttatcttcctcttgatcatcaaagcttcattgttttagaaagcagaggtgaagacccagttttccgcctgacactttccaagctagtgtagaccaagacctgtctacaaacccacgacaaaccttttcacctgtttaatccatatccagaaagacttgtttcataccttgggaaagcatgcaacagtattccccttagatattttggaaacattttgagacaagtatattttttttcctgcctaaaccaagtgttgtttgtatgctaatgagctctacaatcttcccacacattttgttaaatgactttcattgcacatgagctcccattttttattttaaagtgcaaatgggctaataggcctttgacgtgtaatgtatgagttttgccagaaaatcatatcttgtgtatatgcgtgtgtgtgaaattgcttactatgctggttttgtttgttatggctttctctttgggatagttgggttttccagaaccacagatgaaactttttttgttgctatttttatatttttgcagaaacaccgtttagtgagaattcaatgtcaaatatgacatgataccttaattgtaagaagaaggtgggaagggaaagttggtttattaatttttttaaattttgtatgcaaaagcaaatgagtccttaatttcaacattttgttgtgtttaaataatgataagcatcattaacttctgtaacaaactcacagctttacaaattcaatgggtggagaagaaagctgtgtcttagccatgttaggaagacaaatggcttcctgtgtgttgtaagtatttgggctgtttcagcagtgttggtgtggcacaggggactctgtggcatttcagcactatttaggtggcactagggactctgaaattcctgtactgtatctgatgattttggcattagccataggtaggcacagtttgtctcctcacaccagtgtttagtgtgtgaatagccagagctgtggggaagaacacagagaacagacatctgctggatgcctctcagtggagaatgggattccttcacttggtggtgaagcagataggatagaaagcaggattctctttgttaatccagttagcttttgttttcttgatatcccccctgaatacgttgagtatgagagatatgtgggttttttttatttttataattgtacaaaattaagcaaatatcaaatgttttatatactttattaatgttttttttcaaaaggtactttcttatagacatgatacttttttacagcttcagttgcttgtcttctggtatttttgtgttatgggctatggtgagccagaggcaaatctataagccatttttgtttgccaggacatgcaataaaatttaaaaataaatgaaaatacactgaaaaaaaaaaaaaaaaaaaaaaaaaaaaaaa

SEQ ID NO: 44 - protein, 680 aa, Mus musculus
MNFETSRCATLQYCPDPYIQRFIETPAHFSWKESYYRSAMSQSTQTSEFLSPEVFQHIWDFLEQPICSVQPIELNFVDEPSENGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHDFSSPPHLLRTPSGASTVSVGSSETRGERVIDAVRFTLRQTISFPPRDEWNDFNFDMDSRRNKQQRIKEEGE

SEQ ID NO: 45 - DNA, 5288 bp, Mus musculus
aaaacattgtagccacagcagaactgacaggagctctcaaatcaagtcagaatacagatacaaggagatgttattcagttggagcaagggggacatttattagctcagtgacaagtcctggcttctgtgattaaactctgatgccattcataccagcacccaatcccaagcaagatcagaagttcagagatgcctacaaattgccaacaagtgtggccactctacgtcaagggctctaaaactgtggcagagaggaagaacagctttacagggggtgcccagctggtaagaattgacggtttatgatgctctggttacttgaagactctcattggctgaaaggaagaaacgccccgcctctttgcaaatctgagtaaaggggggaagtgtctaaacttctatgtctgatggcatttgaccctattgctttcagcctcctggctacatacctagatattctcaggtgtatatgtatattttatagaattgcttcccatctgttggtatcaaagagagttgaaggaaatgaattttgaaacttcacggtgtgccaccctacagtactgccccgacccttacatccagcgtttcatagaaaccccagctcatttctcgtggaaagaaagttattacagatctgccatgtcgcagagcacccagacaagcgagttcctcagcccagaggtcttccagcatatctgggattttctggaacagcctatatgctcagtacagcccatcgagttgaactttgtggatgaaccttccgaaaatggtgcaacaaacaagattgagattagcatggattgtatccgcatgcaagactcagacctcagtgaccccatgtggccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatggtacgaagcgccctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacagacctcgatgcagtctcagtcttcatatggcaacagttccccacctctgaacaaaatgaacagcatgaacaagctgccttccgtgagccagcttatcaacccacagcagcgcaatgccctcactcccaccaccatgcctgagggcatgggagccaacattcctatgatgggcactcacatgccaatggctggagacatgaatggactcagccctacccaagctctccctcctccactctccatgccctccacctcccactgcaccccaccaccgccctaccccacagactgcagcattgtcaggatttggcaagtctgaagatccctgaacagttccgacatgccatctggaagggcatcctggaccacaggcagctgcacgacttctcctcacctcctcatctcctgaggaccccaagtggtgcctctaccgtcagtgtgggctccagtgagacccgtggtgaacgtgtgatcgatgccgtgcgctttaccctccgccagaccatctcttttccaccccgtgacgagtggaatgatttcaactttgacatggattctcgtcgcaacaagcagcagcgtatcaaagaggaaggagaatgagcgcccattgcggggttcttcctgtcttcttccacctcccagcccctacagggcacgcctgcttgatcctcagagccttctcgttagctcttctccttctccttctcagtctggtttctaaagggacggagaattaggaggctgcctgttacctaaagtctgacctgtcacctgattctgattctggctttaagccttcaatactcttgcttgcaagatgcattgacattgctagatagaagttagcaaagaagcagtaggtctctttaagcagtggagatctctcattgacttttataaagcattttcagccttatagtctaagactatatatataaatatataaatatccgatatatattttgggtgtggggggtattgagtattgtttaaatgtaatttaatggaaattgagttgcacttatcatccttctttggaatttgcttgtttcggatggctgagctgtactcctttctcaggggtatcatgtatggtgacagatatctagagttgaatggtctatgtgagtaacaatgacgtataggacctctcctcatcctttggatggttattgtttagcacatcaaacctgtggatgcatccagtgtgtttaccattgcttcctatgaggtaaaactgtatatatgtacacagttttctctgtcagtatattttatgttactggtgtccattccagttaggctggttcactctgtggctattacaagccacattttaggtttgctttgtcacacactataagacagggcattgtctcttgcttttgtttgagaatgaggaatgcagttgtgttgtggtttgttttgttttattttgttttgttttctggaaactcttaaatggttcaagtcagccattccaaatatctgatgaaatttagcccaatatagcagtagctctttgaaatttaaggcccaacaccctagtatttattagaaaaataaacatttgctgttgttagaatagtcttaaaaataaatttctctgctagattgactaagtaaaatagacattctctgctgttgtgagaatttgggccaattagaatgaatgaaattcgtctagttttcatggggagttgtaatgtctattagaaagattcaggaaaaataagaatgattcagaaatactgaatttccatgaaaaggaaaacagaaagcgattcatcccaccaaactctgaattgaagttccttttgaagggtggagtgatgcttgggaagtggaccttttaaagactttcctatctatgagacactgcatgcacaggcaagtttctctctccccaagggctaaaataagaataatggcttggaaaatacaaacttcgtagtgtagttttcacatagcatgagctgaaccactgttatcttcctcttgatcatcaaagcttcattgttttagaaagcagaggtgaagacccagttttccgcctgacactttccaagctagtgtagaccaagacctgtctacaaacccacgacaaaccttttcacctgtttaatccatatccagaaagacttgtttcataccttgggaaagcatgcaacagtattccccttagatattttggaaacattttgagacaagtatattttttttcctgcctaaaccaagtgttgtttgtatgctaatgagctctacaatcttcccacacattttgttaaatgactttcattgcacatgagctcccattttttattttaaagtgcaaatgggctaataggcctttgacgtgtaatgtatgagttttgccagaaaatcatatcttgtgtatatgcgtgtgtgtgaaattgcttactatgctggttttgtttgttatggctttctctttgggatagttgggttttccagaaccacagatgaaactttttttgttgctatttttatatttttgcagaaacaccgtttagtgagaattcaatgtcaaatatgacatgataccttaattgtaagaagaaggtgggaagggaaagttggtttattaatttttttaaattttgtatgcaaaagcaaatgagtccttaatttcaacattttgttgtgtttaaataatgataagcatcattaacttctgtaacaaactcacagctttacaaattcaatgggtggagaagaaagctgtgtcttagccatgttaggaagacaaatggcttcctgtgtgttgtaagtatttgggctgtttcagcagtgttggtgtggcacaggggactctgtggcatttcagcactatttaggtggcactagggactctgaaattcctgtactgtatctgatgattttggcattagccataggtaggcacagtttgtctcctcacaccagtgtttagtgtgtgaatagccagagctgtggggaagaacacagagaacagacatctgctggatgcctctcagtggagaatgggattccttcacttggtggtgaagcagataggatagaaagcaggattctctttgttaatccagttagcttttgttttcttgatatcccccctgaatacgttgagtatgagagatatgtgggttttttttatttttataattgtacaaaattaagcaaatatcaaatgttttatatactttattaatgttttttttcaaaaggtactttcttatagacatgatacttttttacagcttcagttgcttgtcttctggtatttttgtgttatgggctatggtgagccagaggcaaatctataagccatttttgtttgccaggacatgcaataaaatttaaaaataaatgaaaatacactgaaaaaaaaaaaaaaaaaaaaaaaaaaaaaaa

SEQ ID NO: 46 - protein, 555 aa, Mus musculus
MNFETSRCATLQYCPDPYIQRFIETPAHFSWKESYYRSAMSQSTQTSEFLSPEVFQHIWDFLEQPICSVQPIELNFVDEPSENGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVRIWQV

SEQ ID NO: 47 - DNA, 2380 bp, Mus musculus
aaaacattgtagccacagcagaactgacaggagctctcaaatcaagtcagaatacagatacaaggagatgttattcagttggagcaagggggacatttattagctcagtgacaagtcctggcttctgtgattaaactctgatgccattcataccagcacccaatcccaagcaagatcagaagttcagagatgcctacaaattgccaacaagtgtggccactctacgtcaagggctctaaaactgtggcagagaggaagaacagctttacagggggtgcccagctggtaagaattgacggtttatgatgctctggttacttgaagactctcattggctgaaaggaagaaacgccccgcctctttgcaaatctgagtaaaggggggaagtgtctaaacttctatgtctgatggcatttgaccctattgctttcagcctcctggctacatacctagatattctcaggtgtatatgtatattttatagaattgcttcccatctgttggtatcaaagagagttgaaggaaatgaattttgaaacttcacggtgtgccaccctacagtactgccccgacccttacatccagcgtttcatagaaaccccagctcatttctcgtggaaagaaagttattacagatctgccatgtcgcagagcacccagacaagcgagttcctcagcccagaggtcttccagcatatctgggattttctggaacagcctatatgctcagtacagcccatcgagttgaactttgtggatgaaccttccgaaaatggtgcaacaaacaagattgagattagcatggattgtatccgcatgcaagactcagacctcagtgaccccatgtggccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatgctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacatctcctttcagcctgcttcaggaatgagcttgtggagccccggggagaagctccgacacagtctgacgtcttctttagacattccaaccccccaaaccactccgtgtacccataggtccccagctatgtgtttgagttcatgtgcttgttgtgtttctgtgtgcgtttgtgtatatgcacatgcgtgttagtgtttccagccctcacaaacaggacttgaagacattttggctcagagacccagctgctcaaaggcacacatccactagtgagagaatctttgaagggactcaaaattttacaaagcagagatgctttctgcacattttgtatctttagatcctgccttggttggacgggagccgcgactgtgcttgtctgtgagctttctattgttttcccaggagggagggggaatccattgggaaagaggcattgcaaagtttattggaaaccttttctgttacctcctgttgtgtttctaaaactcataataaagcttttgagcaggtctcaaa

SEQ ID NO: 48 - protein, 483 aa, Mus musculus
MNFETSRCATLQYCPDPYIQRFIETPAHFSWKESYYRSAMSQSTQTSEFLSPEVFQHIWDFLEQPICSVQPIELNFVDEPSENGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDAFRQNTHGIQMTSIKKRRSPDDELLYLPVRGRETYEMLLKIKESLELMQYLPQHTIETYRQQQQQQHQHLLQKHLLSACFRNELVEPRGEAPTQSDVFFRHSNPPNHSVYP

SEQ ID NO: 49 - DNA, 4625 bp, Mus musculus
agagagagagagagagagaggcacctgaattctgttatcttcttagaagattcgcagcgcaaggctctcagagggggtgggggggctggcaaaaccctggaagcagaaaagaggagagcagccttgaccagtctcactgctaacatgttgtacctggaaaacaatgcccagactcaatttagtgagccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatggtacgaagcgccctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacagacctcgatgcagtctcagtcttcatatggcaacagttccccacctctgaacaaaatgaacagcatgaacaagctgccttccgtgagccagcttatcaacccacagcagcgcaatgccctcactcccaccaccatgcctgagggcatgggagccaacattcctatgatgggcactcacatgccaatggctggagacatgaatggactcagccctacccaagctctccctcctccactctccatgccctccacctcccactgcaccccaccaccgccctaccccacagactgcagcattgtcaggatttggcaagtctgaagatccctgaacagttccgacatgccatctggaagggcatcctggaccacaggcagctgcacgacttctcctcacctcctcatctcctgaggaccccaagtggtgcctctaccgtcagtgtgggctccagtgagacccgtggtgaacgtgtgatcgatgccgtgcgctttaccctccgccagaccatctcttttccaccccgtgacgagtggaatgatttcaactttgacatggattctcgtcgcaacaagcagcagcgtatcaaagaggaaggagaatgagcgcccattgcggggttcttcctgtcttcttccacctcccagcccctacagggcacgcctgcttgatcctcagagccttctcgttagctcttctccttctccttctcagtctggtttctaaagggacggagaattaggaggctgcctgttacctaaagtctgacctgtcacctgattctgattctggctttaagccttcaatactcttgcttgcaagatgcattgacattgctagatagaagttagcaaagaagcagtaggtctctttaagcagtggagatctctcattgacttttataaagcattttcagccttatagtctaagactatatatataaatatataaatatccgatatatattttgggtgtggggggtattgagtattgtttaaatgtaatttaatggaaattgagttgcacttatcatccttctttggaatttgcttgtttcggatggctgagctgtactcctttctcaggggtatcatgtatggtgacagatatctagagttgaatggtctatgtgagtaacaatgacgtataggacctctcctcatcctttggatggttattgtttagcacatcaaacctgtggatgcatccagtgtgtttaccattgcttcctatgaggtaaaactgtatatatgtacacagttttctctgtcagtatattttatgttactggtgtccattccagttaggctggttcactctgtggctattacaagccacattttaggtttgctttgtcacacactataagacagggcattgtctcttgcttttgtttgagaatgaggaatgcagttgtgttgtggtttgttttgttttattttgttttgttttctggaaactcttaaatggttcaagtcagccattccaaatatctgatgaaatttagcccaatatagcagtagctctttgaaatttaaggcccaacaccctagtatttattagaaaaataaacatttgctgttgttagaatagtcttaaaaataaatttctctgctagattgactaagtaaaatagacattctctgctgttgtgagaatttgggccaattagaatgaatgaaattcgtctagttttcatggggagttgtaatgtctattagaaagattcaggaaaaataagaatgattcagaaatactgaatttccatgaaaaggaaaacagaaagcgattcatcccaccaaactctgaattgaagttccttttgaagggtggagtgatgcttgggaagtggaccttttaaagactttcctatctatgagacactgcatgcacaggcaagtttctctctccccaagggctaaaataagaataatggcttggaaaatacaaacttcgtagtgtagttttcacatagcatgagctgaaccactgttatcttcctcttgatcatcaaagcttcattgttttagaaagcagaggtgaagacccagttttccgcctgacactttccaagctagtgtagaccaagacctgtctacaaacccacgacaaaccttttcacctgtttaatccatatccagaaagacttgtttcataccttgggaaagcatgcaacagtattccccttagatattttggaaacattttgagacaagtatattttttttcctgcctaaaccaagtgttgtttgtatgctaatgagctctacaatcttcccacacattttgttaaatgactttcattgcacatgagctcccattttttattttaaagtgcaaatgggctaataggcctttgacgtgtaatgtatgagttttgccagaaaatcatatcttgtgtatatgcgtgtgtgtgaaattgcttactatgctggttttgtttgttatggctttctctttgggatagttgggttttccagaaccacagatgaaactttttttgttgctatttttatatttttgcagaaacaccgtttagtgagaattcaatgtcaaatatgacatgataccttaattgtaagaagaaggtgggaagggaaagttggtttattaatttttttaaattttgtatgcaaaagcaaatgagtccttaatttcaacattttgttgtgtttaaataatgataagcatcattaacttctgtaacaaactcacagctttacaaattcaatgggtggagaagaaagctgtgtcttagccatgttaggaagacaaatggcttcctgtgtgttgtaagtatttgggctgtttcagcagtgttggtgtggcacaggggactctgtggcatttcagcactatttaggtggcactagggactctgaaattcctgtactgtatctgatgattttggcattagccataggtaggcacagtttgtctcctcacaccagtgtttagtgtgtgaatagccagagctgtggggaagaacacagagaacagacatctgctggatgcctctcagtggagaatgggattccttcacttggtggtgaagcagataggatagaaagcaggattctctttgttaatccagttagcttttgttttcttgatatcccccctgaatacgttgagtatgagagatatgtgggttttttttatttttataattgtacaaaattaagcaaatatcaaatgttttatatactttattaatgttttttttcaaaaggtactttcttatagacatgatacttttttacagcttcagttgcttgtcttctggtatttttgtgttatgggctatggtgagccagaggcaaatctataagccatttttgtttgccaggacatgcaataaaatttaaaaataaatgaaaatacactgaaaaaaaaaaaaaaaaaaaaaaaaaaaaaaa

SEQ ID NO: 50 - protein, 461 aa, Mus musculus
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVRIWQV

SEQ ID NO: 51 - DNA, 1729 bp, Mus musculus
agagagagagagagagagaggcacctgaattctgttatcttcttagaagattcgcagcgcaaggctctcagagggggtgggggggctggcaaaaccctggaagcagaaaagaggagagcagccttgaccagtctcactgctaacatgttgtacctggaaaacaatgcccagactcaatttagtgagccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatggtacgaagcgccctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacatctcctttcagcctgcttcaggaatgagcttgtggagccccggggagaagctccgacacagtctgacgtcttctttagacattccaaccccccaaaccactccgtgtacccataggtccccagctatgtgtttgagttcatgtgcttgttgtgtttctgtgtgcgtttgtgtatatgcacatgcgtgttagtgtttccagccctcacaaacaggacttgaagacattttggctcagagacccagctgctcaaaggcacacatccactagtgagagaatctttgaagggactcaaaattttacaaagcagagatgctttctgcacattttgtatctttagatcctgccttggttggacgggagccgcgactgtgcttgtctgtgagctttctattgttttcccaggagggagggggaatccattgggaaagaggcattgcaaagtttattggaaaccttttctgttacctcctgttgtgtttctaaaactcataataaagcttttgagcaggtctcaaa

SEQ ID NO: 52 - protein, 393 aa, Mus musculus
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKHLLSACFRNELVEPRGEAPTQSDVFFRHSNPPNHSVYP

SEQ ID NO: 53 - DNA, 4707 bp, Mus musculus
agagagagagagagagagaggcacctgaattctgttatcttcttagaagattcgcagcgcaaggctctcagagggggtgggggggctggcaaaaccctggaagcagaaaagaggagagcagccttgaccagtctcactgctaacatgttgtacctggaaaacaatgcccagactcaatttagtgagccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatgctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacagacctcgatgcagtctcagtcttcatatggcaacagttccccacctctgaacaaaatgaacagcatgaacaagctgccttccgtgagccagcttatcaacccacagcagcgcaatgccctcactcccaccaccatgcctgagggcatgggagccaacattcctatgatgggcactcacatgccaatggctggagacatgaatggactcagccctacccaagctctccctcctccactctccatgccctccacctcccactgcaccccaccaccgccctaccccacagactgcagcattgtcagtttcttagcaaggttgggctgctcatcatgcctggactatttcacgacccaggggctgaccaccatctatcagattgagcattactccatggatgatttggcaagtctgaagatccctgaacagttccgacatgccatctggaagggcatcctggaccacaggcagctgcacgacttctcctcacctcctcatctcctgaggaccccaagtggtgcctctaccgtcagtgtgggctccagtgagacccgtggtgaacgtgtgatcgatgccgtgcgctttaccctccgccagaccatctcttttccaccccgtgacgagtggaatgatttcaactttgacatggattctcgtcgcaacaagcagcagcgtatcaaagaggaaggagaatgagcgcccattgcggggttcttcctgtcttcttccacctcccagcccctacagggcacgcctgcttgatcctcagagccttctcgttagctcttctccttctccttctcagtctggtttctaaagggacggagaattaggaggctgcctgttacctaaagtctgacctgtcacctgattctgattctggctttaagccttcaatactcttgcttgcaagatgcattgacattgctagatagaagttagcaaagaagcagtaggtctctttaagcagtggagatctctcattgacttttataaagcattttcagccttatagtctaagactatatatataaatatataaatatccgatatatattttgggtgtggggggtattgagtattgtttaaatgtaatttaatggaaattgagttgcacttatcatccttctttggaatttgcttgtttcggatggctgagctgtactcctttctcaggggtatcatgtatggtgacagatatctagagttgaatggtctatgtgagtaacaatgacgtataggacctctcctcatcctttggatggttattgtttagcacatcaaacctgtggatgcatccagtgtgtttaccattgcttcctatgaggtaaaactgtatatatgtacacagttttctctgtcagtatattttatgttactggtgtccattccagttaggctggttcactctgtggctattacaagccacattttaggtttgctttgtcacacactataagacagggcattgtctcttgcttttgtttgagaatgaggaatgcagttgtgttgtggtttgttttgttttattttgttttgttttctggaaactcttaaatggttcaagtcagccattccaaatatctgatgaaatttagcccaatatagcagtagctctttgaaatttaaggcccaacaccctagtatttattagaaaaataaacatttgctgttgttagaatagtcttaaaaataaatttctctgctagattgactaagtaaaatagacattctctgctgttgtgagaatttgggccaattagaatgaatgaaattcgtctagttttcatggggagttgtaatgtctattagaaagattcaggaaaaataagaatgattcagaaatactgaatttccatgaaaaggaaaacagaaagcgattcatcccaccaaactctgaattgaagttccttttgaagggtggagtgatgcttgggaagtggaccttttaaagactttcctatctatgagacactgcatgcacaggcaagtttctctctccccaagggctaaaataagaataatggcttggaaaatacaaacttcgtagtgtagttttcacatagcatgagctgaaccactgttatcttcctcttgatcatcaaagcttcattgttttagaaagcagaggtgaagacccagttttccgcctgacactttccaagctagtgtagaccaagacctgtctacaaacccacgacaaaccttttcacctgtttaatccatatccagaaagacttgtttcataccttgggaaagcatgcaacagtattccccttagatattttggaaacattttgagacaagtatattttttttcctgcctaaaccaagtgttgtttgtatgctaatgagctctacaatcttcccacacattttgttaaatgactttcattgcacatgagctcccattttttattttaaagtgcaaatgggctaataggcctttgacgtgtaatgtatgagttttgccagaaaatcatatcttgtgtatatgcgtgtgtgtgaaattgcttactatgctggttttgtttgttatggctttctctttgggatagttgggttttccagaaccacagatgaaactttttttgttgctatttttatatttttgcagaaacaccgtttagtgagaattcaatgtcaaatatgacatgataccttaattgtaagaagaaggtgggaagggaaagttggtttattaatttttttaaattttgtatgcaaaagcaaatgagtccttaatttcaacattttgttgtgtttaaataatgataagcatcattaacttctgtaacaaactcacagctttacaaattcaatgggtggagaagaaagctgtgtcttagccatgttaggaagacaaatggcttcctgtgtgttgtaagtatttgggctgtttcagcagtgttggtgtggcacaggggactctgtggcatttcagcactatttaggtggcactagggactctgaaattcctgtactgtatctgatgattttggcattagccataggtaggcacagtttgtctcctcacaccagtgtttagtgtgtgaatagccagagctgtggggaagaacacagagaacagacatctgctggatgcctctcagtggagaatgggattccttcacttggtggtgaagcagataggatagaaagcaggattctctttgttaatccagttagcttttgttttcttgatatcccccctgaatacgttgagtatgagagatatgtgggttttttttatttttataattgtacaaaattaagcaaatatcaaatgttttatatactttattaatgttttttttcaaaaggtactttcttatagacatgatacttttttacagcttcagttgcttgtcttctggtatttttgtgttatgggctatggtgagccagaggcaaatctataagccatttttgtttgccaggacatgcaataaaatttaaaaataaatgaaaatacactgaaaaaaaaaaaaaaaaaaaaaaaaaaaaaaa

SEQ ID NO: 54 - protein, 582 aa, Mus musculus
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDAFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHDFSSPPHLLRTPSGASTVSVGSSETRGERVIDAVRFTLRQTISFPPRDEWNDFNFDMDSRRNKQQRIKEEGE

SEQ ID NO: 55 - DNA, 1717 bp, Mus musculus
agagagagagagagagagaggcacctgaattctgttatcttcttagaagattcgcagcgcaaggctctcagagggggtgggggggctggcaaaaccctggaagcagaaaagaggagagcagccttgaccagtctcactgctaacatgttgtacctggaaaacaatgcccagactcaatttagtgagccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatgctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacatctcctttcagcctgcttcaggaatgagcttgtggagccccggggagaagctccgacacagtctgacgtcttctttagacattccaaccccccaaaccactccgtgtacccataggtccccagctatgtgtttgagttcatgtgcttgttgtgtttctgtgtgcgtttgtgtatatgcacatgcgtgttagtgtttccagccctcacaaacaggacttgaagacattttggctcagagacccagctgctcaaaggcacacatccactagtgagagaatctttgaagggactcaaaattttacaaagcagagatgctttctgcacattttgtatctttagatcctgccttggttggacgggagccgcgactgtgcttgtctgtgagctttctattgttttcccaggagggagggggaatccattgggaaagaggcattgcaaagtttattggaaaccttttctgttacctcctgttgtgtttctaaaactcataataaagcttttgagcaggtctcaaa

SEQ ID NO: 56 - protein, 389 aa, Mus musculus
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDAFRQNTHGIQMTSIKKRRSPDDELLYLPVRGRETYEMLLKIKESLELMQYLPQHTIETYRQQQQQQHQHLLQKHLLSACFRNELVEPRGEAPTQSDVFFRHSNPPNHSVYP

SEQ ID NO: 57 - DNA, 4710 bp, Mus musculus
agagagagagagagagagaggcacctgaattctgttatcttcttagaagattcgcagcgcaaggctctcagagggggtgggggggctggcaaaaccctggaagcagaaaagaggagagcagccttgaccagtctcactgctaacatgttgtacctggaaaacaatgcccagactcaatttagtgagccacagtacacgaacctggggctcctgaacagcatggaccagcagattcagaacggctcctcgtccaccagcccctacaacacagaccacgcacagaatagcgtgacggcgccctcgccctatgcacagcccagctccacctttgatgccctctctccatcccctgccattccctccaacacagattacccgggcccacacagcttcgatgtgtccttccagcagtcaagcactgccaagtcagccacctggacgtattccaccgaactgaagaagctgtactgccagattgcgaagacatgccccatccagatcaaggtgatgaccccacccccacagggcgctgttatccgtgccatgcctgtctacaagaaagctgagcatgtcaccgaggttgtgaaacgatgccctaaccatgagctgagccgtgagttcaatgagggacagattgcccctcccagtcatctgattcgagtagaagggaacagccatgcccagtatgtagaagatcctatcacgggaaggcagagcgtgctggtcccttatgagccaccacaggttggcactgaattcacaacagtcctgtacaatttcatgtgtaacagcagctgcgtcggaggaatgaacagacgtccaattttaatcatcgttactctggaaaccagagatgggcaagtcctgggccgacggtgctttgaggcccggatctgtgcttgcccaggaagagaccggaaggcagatgaagacagcatcagaaagcagcaagtatcggacagcgcaaagaacggcgatggtacgaagcgccctttccgtcagaatacacacggaatccagatgacttccatcaagaaacggagatccccagatgatgagctgctgtacctaccagtgagaggtcgtgagacgtacgagatgttgctgaagatcaaagagtcactggagctcatgcagtacctccctcagcacacgatcgaaacgtacaggcagcagcagcagcagcagcaccagcacctacttcagaaacagacctcgatgcagtctcagtcttcatatggcaacagttccccacctctgaacaaaatgaacagcatgaacaagctgccttccgtgagccagcttatcaacccacagcagcgcaatgccctcactcccaccaccatgcctgagggcatgggagccaacattcctatgatgggcactcacatgccaatggctggagacatgaatggactcagccctacccaagctctccctcctccactctccatgccctccacctcccactgcaccccaccaccgccctaccccacagactgcagcattgtcagtttcttagcaaggttgggctgctcatcatgcctggactatttcacgacccaggggctgaccaccatctatcagattgagcattactccatggatgatttggcaagtctgaagatccctgaacagttccgacatgccatctggaagggcatcctggaccacaggcagctgcacgacttctcctcacctcctcatctcctgaggaccccaagtggtgcctctaccgtcagtgtgggctccagtgagacccgtggtgaacgtgtgatcgatgccgtgcgctttaccctccgccagaccatctcttttccaccccgtgacgagtggaatgatttcaactttgacatggattctcgtcgcaacaagcagcagcgtatcaaagaggaaggagaatgagcgcccattgcggggttcttcctgtcttcttccacctcccagcccctacagggcacgcctgcttgatcctcagagccttctcgttagctcttctccttctccttctcagtctggtttctaaagggacggagaattaggaggctgcctgttacctaaagtctgacctgtcacctgattctgattctggctttaagccttcaatactcttgcttgcaagatgcattgacattgctagatagaagttagcaaagaagcagtaggtctctttaagcagtggagatctctcattgacttttataaagcattttcagccttatagtctaagactatatatataaatatataaatatccgatatatattttgggtgtggggggtattgagtattgtttaaatgtaatttaatggaaattgagttgcacttatcatccttctttggaatttgcttgtttcggatggctgagctgtactcctttctcaggggtatcatgtatggtgacagatatctagagttgaatggtctatgtgagtaacaatgacgtataggacctctcctcatcctttggatggttattgtttagcacatcaaacctgtggatgcatccagtgtgtttaccattgcttcctatgaggtaaaactgtatatatgtacacagttttctctgtcagtatattttatgttactggtgtccattccagttaggctggttcactctgtggctattacaagccacattttaggtttgctttgtcacacactataagacagggcattgtctcttgcttttgtttgagaatgaggaatgcagttgtgttgtggtttgttttgttttattttgttttgttttctggaaactcttaaatggttcaagtcagccattccaaatatctgatgaaatttagcccaatatagcagtagctctttgaaatttaaggcccaacaccctagtatttattagaaaaataaacatttgctgttgttagaatagtcttaaaaataaatttctctgctagattgactaagtaaaatagacattctctgctgttgtgagaatttgggccaattagaatgaatgaaattcgtctagttttcatggggagttgtaatgtctattagaaagattcaggaaaaataagaatgattcagaaatactgaatttccatgaaaaggaaaacagaaagcgattcatcccaccaaactctgaattgaagttccttttgaagggtggagtgatgcttgggaagtggaccttttaaagactttcctatctatgagacactgcatgcacaggcaagtttctctctccccaagggctaaaataagaataatggcttggaaaatacaaacttcgtagtgtagttttcacatagcatgagctgaaccactgttatcttcctcttgatcatcaaagcttcattgttttagaaagcagaggtgaagacccagttttccgcctgacactttccaagctagtgtagaccaagacctgtctacaaacccacgacaaaccttttcacctgtttaatccatatccagaaagacttgtttcataccttgggaaagcatgcaacagtattccccttagatattttggaaacattttgagacaagtatattttttttcctgcctaaaccaagtgttgtttgtatgctaatgagctctacaatcttcccacacattttgttaaatgactttcattgcacatgagctcccattttttattttaaagtgcaaatgggctaataggcctttgacgtgtaatgtatgagttttgccagaaaatcatatcttgtgtatatgcgtgtgtgtgaaattgcttactatgctggttttgtttgttatggctttctctttgggatagttgggttttccagaaccacagatgaaactttttttgttgctatttttatatttttgcagaaacaccgtttagtgagaattcaatgtcaaatatgacatgataccttaattgtaagaagaaggtgggaagggaaagttggtttattaatttttttaaattttgtatgcaaaagcaaatgagtccttaatttcaacattttgttgtgtttaaataatgataagcatcattaacttctgtaacaaactcacagctttacaaattcaatgggtggagaagaaagctgtgtcttagccatgttaggaagacaaatggcttcctgtgtgttgtaagtatttgggctgtttcagcagtgttggtgtggcacaggggactctgtggcatttcagcactatttaggtggcactagggactctgaaattcctgtactgtatctgatgattttggcattagccataggtaggcacagtttgtctcctcacaccagtgtttagtgtgtgaatagccagagctgtggggaagaacacagagaacagacatctgctggatgcctctcagtggagaatgggattccttcacttggtggtgaagcagataggatagaaagcaggattctctttgttaatccagttagcttttgttttcttgatatcccccctgaatacgttgagtatgagagatatgtgggttttttttatttttataattgtacaaaattaagcaaatatcaaatgttttatatactttattaatgttttttttcaaaaggtactttcttatagacatgatacttttttacagcttcagttgcttgtcttctggtatttttgtgttatgggctatggtgagccagaggcaaatctataagccatttttgtttgccaggacatgcaataaaatttaaaaataaatgaaaatacactgaaaaaaaaaaaaaaaaaaaaaa

SEQ ID NO: 58 - protein, 586 aa, Mus musculus
MLYLENNAQTQFSEPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHDFSSPPHLLRTPSGASTVSVGSSETRGERVIDAVRFTLRQTISFPPRDEWNDFNFDMDSRRNKQQRIKEEGE

SEQ ID NO: 59 - DNA, 4991 bp, Rattus norvegicus
ggggggaagtgtctaaacttctatgtctgatggcatttgaccctattgctttcagcctcctggctatatacctagatattctcaggtgtatatgtatattttatagaattgttccccatctgttggtatcaaagagagttgaaggaaatgaattttgaaacttcacggtgtgctaccctacagtactgccctgacccttacatccagcgtttcatagaaaccccatctcatttctcctggaaagaaagttattaccggtccgccatgtcgcagagcacccagacaagtgagttcctcagcccagaggtgttccagcatatctgggattttctggaacagcctatatgctcagtacagcccatcgacttgaactttgtggacgaaccatcagaaaatggtgcaacaaacaagattgagattagcatggattgtatccgcatgcaagactcagacctcagtgaccccatgtggccacagtacacgaacctggggctcctgaacggcatggaccagcagattcagaacggctcctcatctaccagcccctataacacagaccatgcacagaacagcgtgacggcaccctcgccctatgcacagcccagctcaaccttcgatgccctttctccatcccctgccattccctccaacacagattacccaggcccacacagcttcgatgtgtccttccagcagtcaagcaccgccaagtcagctacctggacgtattccaccgaactgaagaaactctactgccagattgcaaagacctgccccatccagatcaaggtgatgaccccacccccacagggcgccgtcattcgtgccatgcctgtctacaagaaagccgagcatgtcaccgaggttgtgaaacgatgtcctaaccacgagctgagccgcgagttcaatgagggacagattgcccctcccagtcatctgattcgagtagaagggaacagccatgcccagtatgtagaagatcctatcacaggaaggcagagcgtgctggtcccttatgagccaccacaggttggcactgaattcacaacagtcctgtacaatttcatgtgcaacagcagctgtgtcggaggaatgaaccgccgtccaattttaatcatcgttactctggaaaccagagatgggcaagtcctgggccgacgttgctttgaggcccggatctgcgcttgcccaggaagagaccggaaggccgatgaagacagcatcagaaagcagcaagtatcagacagcgcaaagaacggcgatggtacgaagcgccctttccgtcagaatacccacggaatccagatgacttccatcaagaaacggagatccccagatgatgagctgctgtacctaccagtgagaggccgtgagacttatgaaatgctgctcaagatcaaggagtcgctcgagctcatgcagtatctccctcagcacacgatcgagacgtacaggcagcagcagcagcagcagcaccaacacctacttcagaaacagacctcgatgcagtctcagtcttcatacggtaacagctcaccacctctgaacaaaatgaacagcatgaacaagctgccgtctgtgagccagcttatcaacccacagcagcgcaacgccctgactcccaccaccatgcctgagggcatgggagccaacattcctatgatgggcactcacatgccaatggctggagacatgaatggactcagccccacccaagctcttcctcctccactctccatgccctccacctcccactgcacccccccacctccgtacccaacagactgcagcattgtcagtttcttagcaaggttgggctgttcatcatgtctggactatttcacgacccaggggctgaccaccatctatcagattgagcattactccatggatgatttggcaagtctgaagatccctgagcagttccgacatgccatctggaaggggatcctggaccacaggcagctgcatgacttctcctcacctccgcatctcctgagaacccccagtggtgcctctacagtcagtgtgggctccagtgagacccgtggagaacgtgtgattgatgccgtgcgctttactctccgccagaccatctctttcccaccccgtgatgagtggaacgatttcaactttgacatggattcccgtcgcaacaagcagcagcgcatcaaagaggaaggagaatgaacgtccgtcgccgggttcttcctgttttcttcctcctcccagctcccacagggcacgcctgcttgatcctcaaagccttctcgctagctctcctcctcctccttctcagtctggtttctaaagggacggagaattaagaggctacctgttacctaaagtctgacctgtcacctgattctgatcctggctttaagccttcaatactcttgcttgcaagatgcgttgacattgctagatagacgttagcagagaagcagtgggtctctctaagcactggagatcgctcattgacttttataaagcattttcagccttatagtctaagactatatatataaatatataaatatacaatatatatttcgggtgggggtattgagtattgtttaaatgtaatttaatggaaatcgagttgcacttatcaaccttctttggaatttgcttgttttggttggctgatctgtacccctttctcaggggtatcatgtatggtgacagatatttagagttgaatggtctatgtgagtaacagtgatatataggtcctctcctttctttggatgattgccgtttagcacatcaaacctgtggatgcgtccagtctgtttaccattgctccttatgaggtaaaactgcatatactgtcagtctattttatgttactggtgtccattccagttaggctggttcactctgtggccattccaagcaaaattttatgtttgctttgtcacacactagaagacagggcatcatctcttgcttttgtttgagaatgaggagtacttttttttttttctggaaaatcttaaatggtccaaatcagccattccaaatggctgatgaaatgtagccaatatagcagttagctctctaaaatttaagacccaacaccctcgtatttattagtaaaacaaaaatgaaacatttgctgtcattagagtagccttaaaattaaatttcaataccagattgactgagtaaactatgcattcaatgttgttgtgagaattggggctaattagtcaggatgattggaatttgtgtagttttttatggtgagttgcaatatctatttaggaaggttcaggaataataagaatgactcagaaatactcaatctccgtgacaacagaaagcaatctcaccaaactctgaatttaaaccccttttgaaacatggagtgaggcttgggaaatgtaccttttaaagactttcctatctataagacactgcatgcaggggcaagtttaatctctcatcaaggtggaaaataagaatagtagctcggaaactacaaacttgctagtgtagctttcacatggcatgagctcaactattgttattttcctctttatcatcaaagctccattgctgtagaaagcagaggtgaagacccagttttccacctgacactttccgggcaaggcatagaccaagaactgtctacaaaaccagggcaaagctcttcagtgaagctgtttaattcacatggagaaacacttgtttcccactttgggaaagcatgcaacagtgttccccctagatgttttggaaacattttgagtcaaatatatttttcccagactaaaccaggctaatgagctctacaatcctcctgcacattttggtaaagggctgtcattgcacaggagctcccatttttatcttaaagtgcaaatgggctaatacgcctacgaaatgtaatgtatgggttttgccagaaaatagtatattgtgtacacgtgtctgtgtgtgagtgtgagagtgtgtgtgtgtgtgtgtgtgtgtgtgtgtgtgaaattgcatactatgctggttttgtttgttactctttctcttggggatagttgggttttccagaaccacagacgaaacttttttttgttgctgtttttatatttttgcagaaacaccatttagtgagaattcaatgtcaaattagacatgacaccttaattgtaagaaggggggagagggaaagttggttttttttaattttttaaaattttgtatactaaagagaatgagtccttaatttcaacattctgttgcatttaaataatgataagcatcattaacttctgtaacaacttcccagcttggcaaattcaatgcatggagaacaaagctgggccttagccatgttagggagaaaaatggcttcttgggggttgtgagcatttgggttgctttagcaccgttgaggtggcacaggggactcctgaggcatttcagcactacttacgtagcactagggactcggaaattcctgtactgtagctaatgattttggcgttcaccattagcagtagataggccgtttctctcctcacaccagtgttaagcgtgtgagtagccagagctgtggggaagagcatggagaacagacgtctgctggatgcctctcaccggagaatgagattccttcgcgtggtggtgaagtaggataggaagcaggagtctccttgttagtccagttagctattgttttcttgatattcccccccaaaacattgactatgagagatatgtggggcttttttatttttataattgtacaaaattaaacaaatatgaaatgttttatatactttattaatgttttttttcaaaaggtactttcttatagacatgatcctttttttacaggttcagttgcttgtcccttggtatttttgtgttatgggctatggtgagcctgaggcaaatctataagccatttttgtttgccaggacatgcaataaaatttaaaaataaatgaaaatacactgaaaaaaaaaaaaaaaaaaaaaaaaaa

SEQ ID NO: 60 - protein, 680 aa, Rattus norvegicus
MNFETSRCATLQYCPDPYIQRFIETPSHFSWKESYYRSAMSQSTQTSEFLSPEVFQHIWDFLEQPICSVQPIDLNFVDEPSENGATNKIEISMDCIRMQDSDLSDPMWPQYTNLGLLNGMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHDFSSPPHLLRTPSGASTVSVGSSETRGERVIDAVRFTLRQTISFPPRDEWNDFNFDMDSRRNKQQRIKEEGE

SEQ ID NO: 61 - DNA, 4897 bp, Rattus norvegicus
ggggggaagtgtctaaacttctatgtctgatggcatttgaccctattgctttcagcctcctggctatatacctagatattctcaggtgtatatgtatattttatagaattgttccccatctgttggtatcaaagagagttgaaggaaatgaattttgaaacttcacggtgtgctaccctacagtactgccctgacccttacatccagcgtttcatagaaaccccatctcatttctcctggaaagaaagttattaccggtccgccatgtcgcagagcacccagacaagtgagttcctcagcccagaggtgttccagcatatctgggattttctggaacagcctatatgctcagtacagcccatcgacttgaactttgtggacgaaccatcagaaaatggtgcaacaaacaagattgagattagcatggattgtatccgcatgcaagactcagacctcagtgaccccatgtggccacagtacacgaacctggggctcctgaacggcatggaccagcagattcagaacggctcctcatctaccagcccctataacacagaccatgcacagaacagcgtgacggcaccctcgccctatgcacagcccagctcaaccttcgatgccctttctccatcccctgccattccctccaacacagattacccaggcccacacagcttcgatgtgtccttccagcagtcaagcaccgccaagtcagctacctggacgtattccaccgaactgaagaaactctactgccagattgcaaagacctgccccatccagatcaaggtgatgaccccacccccacagggcgccgtcattcgtgccatgcctgtctacaagaaagccgagcatgtcaccgaggttgtgaaacgatgtcctaaccacgagctgagccgcgagttcaatgagggacagattgcccctcccagtcatctgattcgagtagaagggaacagccatgcccagtatgtagaagatcctatcacaggaaggcagagcgtgctggtcccttatgagccaccacaggttggcactgaattcacaacagtcctgtacaatttcatgtgcaacagcagctgtgtcggaggaatgaaccgccgtccaattttaatcatcgttactctggaaaccagagatgggcaagtcctgggccgacgttgctttgaggcccggatctgcgcttgcccaggaagagaccggaaggccgatgaagacagcatcagaaagcagcaagtatcagacagcgcaaagaacggcgatggtacgaagcgccctttccgtcagaatacccacggaatccagatgacttccatcaagaaacggagatccccagatgatgagctgctgtacctaccagtgagaggccgtgagacttatgaaatgctgctcaagatcaaggagtcgctcgagctcatgcagtatctccctcagcacacgatcgagacgtacaggcagcagcagcagcagcagcaccaacacctacttcagaaacagacctcgatgcagtctcagtcttcatacggtaacagctcaccacctctgaacaaaatgaacagcatgaacaagctgccgtctgtgagccagcttatcaacccacagcagcgcaacgccctgactcccaccaccatgcctgagggcatgggagccaacattcctatgatgggcactcacatgccaatggctggagacatgaatggactcagccccacccaagctcttcctcctccactctccatgccctccacctcccactgcacccccccacctccgtacccaacagactgcagcattgtcaggatttggcaagtctgaagatccctgagcagttccgacatgccatctggaaggggatcctggaccacaggcagctgcatgacttctcctcacctccgcatctcctgagaacccccagtggtgcctctacagtcagtgtgggctccagtgagacccgtggagaacgtgtgattgatgccgtgcgctttactctccgccagaccatctctttcccaccccgtgatgagtggaacgatttcaactttgacatggattcccgtcgcaacaagcagcagcgcatcaaagaggaaggagaatgaacgtccgtcgccgggttcttcctgttttcttcctcctcccagctcccacagggcacgcctgcttgatcctcaaagccttctcgctagctctcctcctcctccttctcagtctggtttctaaagggacggagaattaagaggctacctgttacctaaagtctgacctgtcacctgattctgatcctggctttaagccttcaatactcttgcttgcaagatgcgttgacattgctagatagacgttagcagagaagcagtgggtctctctaagcactggagatcgctcattgacttttataaagcattttcagccttatagtctaagactatatatataaatatataaatatacaatatatatttcgggtgggggtattgagtattgtttaaatgtaatttaatggaaatcgagttgcacttatcaaccttctttggaatttgcttgttttggttggctgatctgtacccctttctcaggggtatcatgtatggtgacagatatttagagttgaatggtctatgtgagtaacagtgatatataggtcctctcctttctttggatgattgccgtttagcacatcaaacctgtggatgcgtccagtctgtttaccattgctccttatgaggtaaaactgcatatactgtcagtctattttatgttactggtgtccattccagttaggctggttcactctgtggccattccaagcaaaattttatgtttgctttgtcacacactagaagacagggcatcatctcttgcttttgtttgagaatgaggagtacttttttttttttctggaaaatcttaaatggtccaaatcagccattccaaatggctgatgaaatgtagccaatatagcagttagctctctaaaatttaagacccaacaccctcgtatttattagtaaaacaaaaatgaaacatttgctgtcattagagtagccttaaaattaaatttcaataccagattgactgagtaaactatgcattcaatgttgttgtgagaattggggctaattagtcaggatgattggaatttgtgtagttttttatggtgagttgcaatatctatttaggaaggttcaggaataataagaatgactcagaaatactcaatctccgtgacaacagaaagcaatctcaccaaactctgaatttaaaccccttttgaaacatggagtgaggcttgggaaatgtaccttttaaagactttcctatctataagacactgcatgcaggggcaagtttaatctctcatcaaggtggaaaataagaatagtagctcggaaactacaaacttgctagtgtagctttcacatggcatgagctcaactattgttattttcctctttatcatcaaagctccattgctgtagaaagcagaggtgaagacccagttttccacctgacactttccgggcaaggcatagaccaagaactgtctacaaaaccagggcaaagctcttcagtgaagctgtttaattcacatggagaaacacttgtttcccactttgggaaagcatgcaacagtgttccccctagatgttttggaaacattttgagtcaaatatatttttcccagactaaaccaggctaatgagctctacaatcctcctgcacattttggtaaagggctgtcattgcacaggagctcccatttttatcttaaagtgcaaatgggctaatacgcctacgaaatgtaatgtatgggttttgccagaaaatagtatattgtgtacacgtgtctgtgtgtgagtgtgagagtgtgtgtgtgtgtgtgtgtgtgtgtgtgtgtgaaattgcatactatgctggttttgtttgttactctttctcttggggatagttgggttttccagaaccacagacgaaacttttttttgttgctgtttttatatttttgcagaaacaccatttagtgagaattcaatgtcaaattagacatgacaccttaattgtaagaaggggggagagggaaagttggttttttttaattttttaaaattttgtatactaaagagaatgagtccttaatttcaacattctgttgcatttaaataatgataagcatcattaacttctgtaacaacttcccagcttggcaaattcaatgcatggagaacaaagctgggccttagccatgttagggagaaaaatggcttcttgggggttgtgagcatttgggttgctttagcaccgttgaggtggcacaggggactcctgaggcatttcagcactacttacgtagcactagggactcggaaattcctgtactgtagctaatgattttggcgttcaccattagcagtagataggccgtttctctcctcacaccagtgttaagcgtgtgagtagccagagctgtggggaagagcatggagaacagacgtctgctggatgcctctcaccggagaatgagattccttcgcgtggtggtgaagtaggataggaagcaggagtctccttgttagtccagttagctattgttttcttgatattcccccccaaaacattgactatgagagatatgtggggcttttttatttttataattgtacaaaattaaacaaatatgaaatgttttatatactttattaatgttttttttcaaaaggtactttcttatagacatgatcctttttttacaggttcagttgcttgtcccttggtatttttgtgttatgggctatggtgagcctgaggcaaatctataagccatttttgtttgccaggacatgcaataaaatttaaaaataaatgaaaatacactgaaaaaaaaaaaaaaaaaaaaaaaaaa

SEQ ID NO: 62 - protein, 555 aa, Rattus norvegicus
MNFETSRCATLQYCPDPYIQRFIETPSHFSWKESYYRSAMSQSTQTSEFLSPEVFQHIWDFLEQPICSVQPIDLNFVDEPSENGATNKIEISMDCIRMQDSDLSDPMWPQYTNLGLLNGMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVRIWQV

SEQ ID NO: 63 - DNA, 1611 bp, Rattus norvegicus
ggggggaagtgtctaaacttctatgtctgatggcatttgaccctattgctttcagcctcctggctatatacctagatattctcaggtgtatatgtatattttatagaattgttccccatctgttggtatcaaagagagttgaaggaaatgaattttgaaacttcacggtgtgctaccctacagtactgccctgacccttacatccagcgtttcatagaaaccccatctcatttctcctggaaagaaagttattaccggtccgccatgtcgcagagcacccagacaagtgagttcctcagcccagaggtgttccagcatatctgggattttctggaacagcctatatgctcagtacagcccatcgacttgaactttgtggacgaaccatcagaaaatggtgcaacaaacaagattgagattagcatggattgtatccgcatgcaagactcagacctcagtgaccccatgtggccacagtacacgaacctggggctcctgaacggcatggaccagcagattcagaacggctcctcatctaccagcccctataacacagaccatgcacagaacagcgtgacggcaccctcgccctatgcacagcccagctcaaccttcgatgccctttctccatcccctgccattccctccaacacagattacccaggcccacacagcttcgatgtgtccttccagcagtcaagcaccgccaagtcagctacctggacgtattccaccgaactgaagaaactctactgccagattgcaaagacctgccccatccagatcaaggtgatgaccccacccccacagggcgccgtcattcgtgccatgcctgtctacaagaaagccgagcatgtcaccgaggttgtgaaacgatgtcctaaccacgagctgagccgcgagttcaatgagggacagattgcccctcccagtcatctgattcgagtagaagggaacagccatgcccagtatgtagaagatcctatcacaggaaggcagagcgtgctggtcccttatgagccaccacaggttggcactgaattcacaacagtcctgtacaatttcatgtgcaacagcagctgtgtcggaggaatgaaccgccgtccaattttaatcatcgttactctggaaaccagagatgggcaagtcctgggccgacgttgctttgaggcccggatctgcgcttgcccaggaagagaccggaaggccgatgaagacagcatcagaaagcagcaagtatcagacagcgcaaagaacggcgatggtacgaagcgccctttccgtcagaatacccacggaatccagatgacttccatcaagaaacggagatccccagatgatgagctgctgtacctaccagtgagaggccgtgagacttatgaaatgctgctcaagatcaaggagtcgctcgagctcatgcagtatctccctcagcacacgatcgagacgtacaggcagcagcagcagcagcagcaccaacacctacttcagaaacatctcctttcagcctgcttcaggaatgagcttgtggagtcccggagagaagctccgacacagtctgacgtcttctttagacattccaaccccccaaaccactcagtgtacccatag

SEQ ID NO: 64 - protein, 487 aa, Rattus norvegicus
MNFETSRCATLQYCPDPYIQRFIETPSHFSWKESYYRSAMSQSTQTSEFLSPEVFQHIWDFLEQPICSVQPIDLNFVDEPSENGATNKIEISMDCIRMQDSDLSDPMWPQYTNLGLLNGMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKHLLSACFRNELVESRREAPTQSDVFFRHSNPPNHSVYP

SEQ ID NO: 65 - DNA, 4562 bp, Rattus norvegicus
atgttgtacctggaaagcaatgcccagactcaatttagtgagccacagtacacgaacctggggctcctgaacggcatggaccagcagattcagaacggctcctcatctaccagcccctataacacagaccatgcacagaacagcgtgacggcaccctcgccctatgcacagcccagctcaaccttcgatgccctttctccatcccctgccattccctccaacacagattacccaggcccacacagcttcgatgtgtccttccagcagtcaagcaccgccaagtcagctacctggacgtattccaccgaactgaagaaactctactgccagattgcaaagacctgccccatccagatcaaggtgatgaccccacccccacagggcgccgtcattcgtgccatgcctgtctacaagaaagccgagcatgtcaccgaggttgtgaaacgatgtcctaaccacgagctgagccgcgagttcaatgagggacagattgcccctcccagtcatctgattcgagtagaagggaacagccatgcccagtatgtagaagatcctatcacaggaaggcagagcgtgctggtcccttatgagccaccacaggttggcactgaattcacaacagtcctgtacaatttcatgtgcaacagcagctgtgtcggaggaatgaaccgccgtccaattttaatcatcgttactctggaaaccagagatgggcaagtcctgggccgacgttgctttgaggcccggatctgcgcttgcccaggaagagaccggaaggccgatgaagacagcatcagaaagcagcaagtatcagacagcgcaaagaacggcgatggtacgaagcgccctttccgtcagaatacccacggaatccagatgacttccatcaagaaacggagatccccagatgatgagctgctgtacctaccagtgagaggccgtgagacttatgaaatgctgctcaagatcaaggagtcgctcgagctcatgcagtatctccctcagcacacgatcgagacgtacaggcagcagcagcagcagcagcaccaacacctacttcagaaacagacctcgatgcagtctcagtcttcatacggtaacagctcaccacctctgaacaaaatgaacagcatgaacaagctgccgtctgtgagccagcttatcaacccacagcagcgcaacgccctgactcccaccaccatgcctgagggcatgggagccaacattcctatgatgggcactcacatgccaatggctggagacatgaatggactcagccccacccaagctcttcctcctccactctccatgccctccacctcccactgcacccccccacctccgtacccaacagactgcagcattgtcagtttcttagcaaggttgggctgttcatcatgtctggactatttcacgacccaggggctgaccaccatctatcagattgagcattactccatggatgatttggcaagtctgaagatccctgagcagttccgacatgccatctggaaggggatcctggaccacaggcagctgcatgacttctcctcacctccgcatctcctgagaacccccagtggtgcctctacagtcagtgtgggctccagtgagacccgtggagaacgtgtgattgatgccgtgcgctttactctccgccagaccatctctttcccaccccgtgatgagtggaacgatttcaactttgacatggattcccgtcgcaacaagcagcagcgcatcaaagaggaaggagaatgaacgtccgtcgccgggttcttcctgttttcttcctcctcccagctcccacagggcacgcctgcttgatcctcaaagccttctcgctagctctcctcctcctccttctcagtctggtttctaaagggacggagaattaagaggctacctgttacctaaagtctgacctgtcacctgattctgatcctggctttaagccttcaatactcttgcttgcaagatgcgttgacattgctagatagacgttagcagagaagcagtgggtctctctaagcactggagatcgctcattgacttttataaagcattttcagccttatagtctaagactatatatataaatatataaatatacaatatatatttcgggtgggggtattgagtattgtttaaatgtaatttaatggaaatcgagttgcacttatcaaccttctttggaatttgcttgttttggttggctgatctgtacccctttctcaggggtatcatgtatggtgacagatatttagagttgaatggtctatgtgagtaacagtgatatataggtcctctcctttctttggatgattgccgtttagcacatcaaacctgtggatgcgtccagtctgtttaccattgctccttatgaggtaaaactgcatatactgtcagtctattttatgttactggtgtccattccagttaggctggttcactctgtggccattccaagcaaaattttatgtttgctttgtcacacactagaagacagggcatcatctcttgcttttgtttgagaatgaggagtacttttttttttttctggaaaatcttaaatggtccaaatcagccattccaaatggctgatgaaatgtagccaatatagcagttagctctctaaaatttaagacccaacaccctcgtatttattagtaaaacaaaaatgaaacatttgctgtcattagagtagccttaaaattaaatttcaataccagattgactgagtaaactatgcattcaatgttgttgtgagaattggggctaattagtcaggatgattggaatttgtgtagttttttatggtgagttgcaatatctatttaggaaggttcaggaataataagaatgactcagaaatactcaatctccgtgacaacagaaagcaatctcaccaaactctgaatttaaaccccttttgaaacatggagtgaggcttgggaaatgtaccttttaaagactttcctatctataagacactgcatgcaggggcaagtttaatctctcatcaaggtggaaaataagaatagtagctcggaaactacaaacttgctagtgtagctttcacatggcatgagctcaactattgttattttcctctttatcatcaaagctccattgctgtagaaagcagaggtgaagacccagttttccacctgacactttccgggcaaggcatagaccaagaactgtctacaaaaccagggcaaagctcttcagtgaagctgtttaattcacatggagaaacacttgtttcccactttgggaaagcatgcaacagtgttccccctagatgttttggaaacattttgagtcaaatatatttttcccagactaaaccaggctaatgagctctacaatcctcctgcacattttggtaaagggctgtcattgcacaggagctcccatttttatcttaaagtgcaaatgggctaatacgcctacgaaatgtaatgtatgggttttgccagaaaatagtatattgtgtacacgtgtctgtgtgtgagtgtgagagtgtgtgtgtgtgtgtgtgtgtgtgtgtgtgtgaaattgcatactatgctggttttgtttgttactctttctcttggggatagttgggttttccagaaccacagacgaaacttttttttgttgctgtttttatatttttgcagaaacaccatttagtgagaattcaatgtcaaattagacatgacaccttaattgtaagaaggggggagagggaaagttggttttttttaattttttaaaattttgtatactaaagagaatgagtccttaatttcaacattctgttgcatttaaataatgataagcatcattaacttctgtaacaacttcccagcttggcaaattcaatgcatggagaacaaagctgggccttagccatgttagggagaaaaatggcttcttgggggttgtgagcatttgggttgctttagcaccgttgaggtggcacaggggactcctgaggcatttcagcactacttacgtagcactagggactcggaaattcctgtactgtagctaatgattttggcgttcaccattagcagtagataggccgtttctctcctcacaccagtgttaagcgtgtgagtagccagagctgtggggaagagcatggagaacagacgtctgctggatgcctctcaccggagaatgagattccttcgcgtggtggtgaagtaggataggaagcaggagtctccttgttagtccagttagctattgttttcttgatattcccccccaaaacattgactatgagagatatgtggggcttttttatttttataattgtacaaaattaaacaaatatgaaatgttttatatactttattaatgttttttttcaaaaggtactttcttatagacatgatcctttttttacaggttcagttgcttgtcccttggtatttttgtgttatgggctatggtgagcctgaggcaaatctataagccatttttgtttgccaggacatgcaataaaatttaaaaataaatgaaaatacactgaaaaaaaaaaaaaaaaaaaaaaaaaa

SEQ ID NO: 66 - protein, 586 aa, Rattus norvegicus
MLYLESNAQTQFSEPQYTNLGLLNGMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHDFSSPPHLLRTPSGASTVSVGSSETRGERVIDAVRFTLRQTISFPPRDEWNDFNFDMDSRRNKQQRIKEEGE

SEQ ID NO: 67 - DNA, 4468 bp, Rattus norvegicus
atgttgtacctggaaagcaatgcccagactcaatttagtgagccacagtacacgaacctggggctcctgaacggcatggaccagcagattcagaacggctcctcatctaccagcccctataacacagaccatgcacagaacagcgtgacggcaccctcgccctatgcacagcccagctcaaccttcgatgccctttctccatcccctgccattccctccaacacagattacccaggcccacacagcttcgatgtgtccttccagcagtcaagcaccgccaagtcagctacctggacgtattccaccgaactgaagaaactctactgccagattgcaaagacctgccccatccagatcaaggtgatgaccccacccccacagggcgccgtcattcgtgccatgcctgtctacaagaaagccgagcatgtcaccgaggttgtgaaacgatgtcctaaccacgagctgagccgcgagttcaatgagggacagattgcccctcccagtcatctgattcgagtagaagggaacagccatgcccagtatgtagaagatcctatcacaggaaggcagagcgtgctggtcccttatgagccaccacaggttggcactgaattcacaacagtcctgtacaatttcatgtgcaacagcagctgtgtcggaggaatgaaccgccgtccaattttaatcatcgttactctggaaaccagagatgggcaagtcctgggccgacgttgctttgaggcccggatctgcgcttgcccaggaagagaccggaaggccgatgaagacagcatcagaaagcagcaagtatcagacagcgcaaagaacggcgatggtacgaagcgccctttccgtcagaatacccacggaatccagatgacttccatcaagaaacggagatccccagatgatgagctgctgtacctaccagtgagaggccgtgagacttatgaaatgctgctcaagatcaaggagtcgctcgagctcatgcagtatctccctcagcacacgatcgagacgtacaggcagcagcagcagcagcagcaccaacacctacttcagaaacagacctcgatgcagtctcagtcttcatacggtaacagctcaccacctctgaacaaaatgaacagcatgaacaagctgccgtctgtgagccagcttatcaacccacagcagcgcaacgccctgactcccaccaccatgcctgagggcatgggagccaacattcctatgatgggcactcacatgccaatggctggagacatgaatggactcagccccacccaagctcttcctcctccactctccatgccctccacctcccactgcacccccccacctccgtacccaacagactgcagcattgtcaggatttggcaagtctgaagatccctgagcagttccgacatgccatctggaaggggatcctggaccacaggcagctgcatgacttctcctcacctccgcatctcctgagaacccccagtggtgcctctacagtcagtgtgggctccagtgagacccgtggagaacgtgtgattgatgccgtgcgctttactctccgccagaccatctctttcccaccccgtgatgagtggaacgatttcaactttgacatggattcccgtcgcaacaagcagcagcgcatcaaagaggaaggagaatgaacgtccgtcgccgggttcttcctgttttcttcctcctcccagctcccacagggcacgcctgcttgatcctcaaagccttctcgctagctctcctcctcctccttctcagtctggtttctaaagggacggagaattaagaggctacctgttacctaaagtctgacctgtcacctgattctgatcctggctttaagccttcaatactcttgcttgcaagatgcgttgacattgctagatagacgttagcagagaagcagtgggtctctctaagcactggagatcgctcattgacttttataaagcattttcagccttatagtctaagactatatatataaatatataaatatacaatatatatttcgggtgggggtattgagtattgtttaaatgtaatttaatggaaatcgagttgcacttatcaaccttctttggaatttgcttgttttggttggctgatctgtacccctttctcaggggtatcatgtatggtgacagatatttagagttgaatggtctatgtgagtaacagtgatatataggtcctctcctttctttggatgattgccgtttagcacatcaaacctgtggatgcgtccagtctgtttaccattgctccttatgaggtaaaactgcatatactgtcagtctattttatgttactggtgtccattccagttaggctggttcactctgtggccattccaagcaaaattttatgtttgctttgtcacacactagaagacagggcatcatctcttgcttttgtttgagaatgaggagtacttttttttttttctggaaaatcttaaatggtccaaatcagccattccaaatggctgatgaaatgtagccaatatagcagttagctctctaaaatttaagacccaacaccctcgtatttattagtaaaacaaaaatgaaacatttgctgtcattagagtagccttaaaattaaatttcaataccagattgactgagtaaactatgcattcaatgttgttgtgagaattggggctaattagtcaggatgattggaatttgtgtagttttttatggtgagttgcaatatctatttaggaaggttcaggaataataagaatgactcagaaatactcaatctccgtgacaacagaaagcaatctcaccaaactctgaatttaaaccccttttgaaacatggagtgaggcttgggaaatgtaccttttaaagactttcctatctataagacactgcatgcaggggcaagtttaatctctcatcaaggtggaaaataagaatagtagctcggaaactacaaacttgctagtgtagctttcacatggcatgagctcaactattgttattttcctctttatcatcaaagctccattgctgtagaaagcagaggtgaagacccagttttccacctgacactttccgggcaaggcatagaccaagaactgtctacaaaaccagggcaaagctcttcagtgaagctgtttaattcacatggagaaacacttgtttcccactttgggaaagcatgcaacagtgttccccctagatgttttggaaacattttgagtcaaatatatttttcccagactaaaccaggctaatgagctctacaatcctcctgcacattttggtaaagggctgtcattgcacaggagctcccatttttatcttaaagtgcaaatgggctaatacgcctacgaaatgtaatgtatgggttttgccagaaaatagtatattgtgtacacgtgtctgtgtgtgagtgtgagagtgtgtgtgtgtgtgtgtgtgtgtgtgtgtgtgaaattgcatactatgctggttttgtttgttactctttctcttggggatagttgggttttccagaaccacagacgaaacttttttttgttgctgtttttatatttttgcagaaacaccatttagtgagaattcaatgtcaaattagacatgacaccttaattgtaagaaggggggagagggaaagttggttttttttaattttttaaaattttgtatactaaagagaatgagtccttaatttcaacattctgttgcatttaaataatgataagcatcattaacttctgtaacaacttcccagcttggcaaattcaatgcatggagaacaaagctgggccttagccatgttagggagaaaaatggcttcttgggggttgtgagcatttgggttgctttagcaccgttgaggtggcacaggggactcctgaggcatttcagcactacttacgtagcactagggactcggaaattcctgtactgtagctaatgattttggcgttcaccattagcagtagataggccgtttctctcctcacaccagtgttaagcgtgtgagtagccagagctgtggggaagagcatggagaacagacgtctgctggatgcctctcaccggagaatgagattccttcgcgtggtggtgaagtaggataggaagcaggagtctccttgttagtccagttagctattgttttcttgatattcccccccaaaacattgactatgagagatatgtggggcttttttatttttataattgtacaaaattaaacaaatatgaaatgttttatatactttattaatgttttttttcaaaaggtactttcttatagacatgatcctttttttacaggttcagttgcttgtcccttggtatttttgtgttatgggctatggtgagcctgaggcaaatctataagccatttttgtttgccaggacatgcaataaaatttaaaaataaatgaaaatacactgaaaaaaaaaaaaaaaaaaaaaaaaaa

SEQ ID NO: 68 - protein, 461 aa, Rattus norvegicus
MLYLESNAQTQFSEPQYTNLGLLNGMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKQTSMQSQSSYGNSSPPLNKMNSMNKLPSVSQLINPQQRNALTPTTMPEGMGANIPMMGTHMPMAGDMNGLSPTQALPPPLSMPSTSHCTPPPPYPTDCSIVRIWQV

SEQ ID NO: 69 - DNA, 1182 bp, Rattus norvegicus
atgttgtacctggaaagcaatgcccagactcaatttagtgagccacagtacacgaacctggggctcctgaacggcatggaccagcagattcagaacggctcctcatctaccagcccctataacacagaccatgcacagaacagcgtgacggcaccctcgccctatgcacagcccagctcaaccttcgatgccctttctccatcccctgccattccctccaacacagattacccaggcccacacagcttcgatgtgtccttccagcagtcaagcaccgccaagtcagctacctggacgtattccaccgaactgaagaaactctactgccagattgcaaagacctgccccatccagatcaaggtgatgaccccacccccacagggcgccgtcattcgtgccatgcctgtctacaagaaagccgagcatgtcaccgaggttgtgaaacgatgtcctaaccacgagctgagccgcgagttcaatgagggacagattgcccctcccagtcatctgattcgagtagaagggaacagccatgcccagtatgtagaagatcctatcacaggaaggcagagcgtgctggtcccttatgagccaccacaggttggcactgaattcacaacagtcctgtacaatttcatgtgcaacagcagctgtgtcggaggaatgaaccgccgtccaattttaatcatcgttactctggaaaccagagatgggcaagtcctgggccgacgttgctttgaggcccggatctgcgcttgcccaggaagagaccggaaggccgatgaagacagcatcagaaagcagcaagtatcagacagcgcaaagaacggcgatggtacgaagcgccctttccgtcagaatacccacggaatccagatgacttccatcaagaaacggagatccccagatgatgagctgctgtacctaccagtgagaggccgtgagacttatgaaatgctgctcaagatcaaggagtcgctcgagctcatgcagtatctccctcagcacacgatcgagacgtacaggcagcagcagcagcagcagcaccaacacctacttcagaaacatctcctttcagcctgcttcaggaatgagcttgtggagtcccggagagaagctccgacacagtctgacgtcttctttagacattccaaccccccaaaccactcagtgtacccatag

SEQ ID NO: 70 - protein, 393 aa, Rattus norvegicus
MLYLESNAQTQFSEPQYTNLGLLNGMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSAKNGDGTKRPFRQNTHGIQMTSIKKRRSPDDELLYLPVRGRETYEMLLKIKESLELMQYLPQHTIETYRQQQQQQHQHLLQKHLLSACFRNELVESRREAPTQSDVFFRHSNPPNHSVYP

SEQ ID NO: 71 - protein, 393 aa, Homo sapiens [sequence omitted]

SEQ ID NO: 72 - DNA, 2591 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 73 - DNA, 2588 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 74 - protein, 341 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 75 - DNA, 2724 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 76 - protein, 346 aa, Homo sapiens
MEEPQSDPSVEPPLSQETFSDLWKLLPENNVLSPLPSQAMDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 77 - DNA, 2651 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 78 - protein, 261 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 79 - DNA, 2271 bp, Homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 80 - protein, 209 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 81 - DNA, 2404 bp, Homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcaggaccagaccagctttcaaaaagaaaattgttaaagagagcatgaaaatggttctatgactttgcctgatacagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 82 - protein, 214 aa, Homo sapiens
MFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 83 - DNA, 2331 bp, Homo sapiens
tgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatgctacttgacttacgatggtgttacttcctgataaactcgtcgtaagttgaaaatattatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 84 - protein, 354 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 85 - DNA, 2708 bp, Homo sapiens
gatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 86 - DNA, 2591 bp, Homo sapiens; identical to SEQ ID NO: 72

SEQ ID NO: 87 - DNA, 2588 bp, Homo sapiens; identical to SEQ ID NO: 73

SEQ ID NO: 88 - protein, 307 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 89 - DNA, 2651 bp, Homo sapiens; identical to SEQ ID NO: 77

SEQ ID NO: 90 - protein, 302 aa, Homo sapiens
MDDLMLSPDDIEQWFTEDPGPDEAPRMPEAAPPVAPAPAAPTPAAPAPAPSWPLSSSVPSQKTYQGSYGFRLGFLHSGTAKSVTCTYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 91 - DNA, 2724 bp, Homo sapiens; identical to SEQ ID NO: 75

SEQ ID NO: 92 - protein, 234 aa, Homo sapiens
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQIRGRERFEMFRELNEALELKDAQAGKEPGGSRAHSSHLKSKKGQSTSRHKKLMFKTEGPDSD

SEQ ID NO: 93 - DNA, 2271 bp, Homo sapiens; identical to SEQ ID NO: 79

SEQ ID NO: 94 - protein, 182 aa, Homo sapiens
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQDQTSFQKENC

SEQ ID NO: 95 - DNA, 2404 bp, Homo sapiens; identical to SEQ ID NO: 81

SEQ ID NO: 96 - protein, 187 aa, Homo sapiens
MAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQMLLDLRWCYFLINSS

SEQ ID NO: 97 - DNA, 2331 bp, Homo sapiens; identical to SEQ ID NO: 83

SEQ ID NO: 98 - protein, 381 aa, Mus musculus
MTAMEESQSDISLELPLSQETFSGLWKLLPPEDILPSPHCMDDLLLPQDVEEFFEGPSEALRVSGAPAAQDPVTETPGPVAPAPATPWPLSSFVPSQKTYQGNYGFHLGFLQSGTAKSVMCTYSPPLNKLFCQLAKTCPVQLWVSATPPAGSRVRAMAIYKKSQHMTEVVRRCPHHERCSDGDGLAPPQHLIRVEGNLYPEYLEDRQTFRHSVVVPYEPPEAGSEYTTIHYKYMCNSSCMGGMNRRPILTIITLEDSSGNLLGRDSFEVRVCACPGRDRRTEEENFRKKEVLCPELPPGSAKRALPTCTSASPPQKKKPLDGEYFTLKIRGRKRFEMFRELNEALELKDAHATEESGDSRAHSSLQPRAFQALIKEESPNC

SEQ ID NO: 99 - DNA, 1877 bp, Mus musculus
tttcccctcccacgtgctcaccctggctaaagttctgtagcttcagttcattgggaccatcctggctgtaggtagcgactacagttagggggcacctagcattcaggccctcatcctcctccttcccagcagggtgtcacgcttctccgaagactggatgactgccatggaggagtcacagtcggatatcagcctcgagctccctctgagccaggagacattttcaggcttatggaaactacttcctccagaagatatcctgccatcacctcactgcatggacgatctgttgctgccccaggatgttgaggagttttttgaaggcccaagtgaagccctccgagtgtcaggagctcctgcagcacaggaccctgtcaccgagacccctgggccagtggcccctgccccagccactccatggcccctgtcatcttttgtcccttctcaaaaaacttaccagggcaactatggcttccacctgggcttcctgcagtctgggacagccaagtctgttatgtgcacgtactctcctcccctcaataagctattctgccagctggcgaagacgtgccctgtgcagttgtgggtcagcgccacacctccagctgggagccgtgtccgcgccatggccatctacaagaagtcacagcacatgacggaggtcgtgagacgctgcccccaccatgagcgctgctccgatggtgatggcctggctcctccccagcatcttatccgggtggaaggaaatttgtatcccgagtatctggaagacaggcagacttttcgccacagcgtggtggtaccttatgagccacccgaggccggctctgagtataccaccatccactacaagtacatgtgtaatagctcctgcatggggggcatgaaccgccgacctatccttaccatcatcacactggaagactccagtgggaaccttctgggacgggacagctttgaggttcgtgtttgtgcctgccctgggagagaccgccgtacagaagaagaaaatttccgcaaaaaggaagtcctttgccctgaactgcccccagggagcgcaaagagagcgctgcccacctgcacaagcgcctctcccccgcaaaagaaaaaaccacttgatggagagtatttcaccctcaagatccgcgggcgtaaacgcttcgagatgttccgggagctgaatgaggccttagagttaaaggatgcccatgctacagaggagtctggagacagcagggctcactccagcctccagcctagagccttccaagccttgatcaaggaggaaagcccaaactgctagctcccatcacttcatccctccccttttctgtcttcctatagctacctgaagaccaagaagggccagtctacttcccgccataaaaaaacaatggtcaagaaagtggggcctgactcagactgactgcctctgcatcccgtccccatcaccagcctccccctctccttgctgtcttatgacttcagggctgagacacaatcctcccggtcccttctgctgccttttttaccttgtagctagggctcagccccctctctgagtagtggttcctggcccaagttggggaataggttgatagttgtcaggtctctgctggcccagcgaaattctatccagccagttgttggaccctggcacctacaatgaaatctcaccctaccccacaccctgtaagattctatcttgggccctcatagggtccatatcctccagggcctactttccttccattctgcaaagcctgtctgcatttatccaccccccaccctgtctccctcttttttttttttttacccctttttatatatcaatttcctattttacaataaaattttgttatcacttaaaaaaaaaa

SEQ ID NO: 100 - protein, 390 aa, Mus musculus
MTAMEESQSDISLELPLSQETFSGLWKLLPPEDILPSPHCMDDLLLPQDVEEFFEGPSEALRVSGAPAAQDPVTETPGPVAPAPATPWPLSSFVPSQKTYQGNYGFHLGFLQSGTAKSVMCTYSPPLNKLFCQLAKTCPVQLWVSATPPAGSRVRAMAIYKKSQHMTEVVRRCPHHERCSDGDGLAPPQHLIRVEGNLYPEYLEDRQTFRHSVVVPYEPPEAGSEYTTIHYKYMCNSSCMGGMNRRPILTIITLEDSSGNLLGRDSFEVRVCACPGRDRRTEEENFRKKEVLCPELPPGSAKRALPTCTSASPPQKKKPLDGEYFTLKIRGRKRFEMFRELNEALELKDAHATEESGDSRAHSSYLKTKKGQSTSRHKKTMVKKVGPDSD

SEQ ID NO: 101 - DNA, 1781 bp, Mus musculus
tttcccctcccacgtgctcaccctggctaaagttctgtagcttcagttcattgggaccatcctggctgtaggtagcgactacagttagggggcacctagcattcaggccctcatcctcctccttcccagcagggtgtcacgcttctccgaagactggatgactgccatggaggagtcacagtcggatatcagcctcgagctccctctgagccaggagacattttcaggcttatggaaactacttcctccagaagatatcctgccatcacctcactgcatggacgatctgttgctgccccaggatgttgaggagttttttgaaggcccaagtgaagccctccgagtgtcaggagctcctgcagcacaggaccctgtcaccgagacccctgggccagtggcccctgccccagccactccatggcccctgtcatcttttgtcccttctcaaaaaacttaccagggcaactatggcttccacctgggcttcctgcagtctgggacagccaagtctgttatgtgcacgtactctcctcccctcaataagctattctgccagctggcgaagacgtgccctgtgcagttgtgggtcagcgccacacctccagctgggagccgtgtccgcgccatggccatctacaagaagtcacagcacatgacggaggtcgtgagacgctgcccccaccatgagcgctgctccgatggtgatggcctggctcctccccagcatcttatccgggtggaaggaaatttgtatcccgagtatctggaagacaggcagacttttcgccacagcgtggtggtaccttatgagccacccgaggccggctctgagtataccaccatccactacaagtacatgtgtaatagctcctgcatggggggcatgaaccgccgacctatccttaccatcatcacactggaagactccagtgggaaccttctgggacgggacagctttgaggttcgtgtttgtgcctgccctgggagagaccgccgtacagaagaagaaaatttccgcaaaaaggaagtcctttgccctgaactgcccccagggagcgcaaagagagcgctgcccacctgcacaagcgcctctcccccgcaaaagaaaaaaccacttgatggagagtatttcaccctcaagatccgcgggcgtaaacgcttcgagatgttccgggagctgaatgaggccttagagttaaaggatgcccatgctacagaggagtctggagacagcagggctcactccagctacctgaagaccaagaagggccagtctacttcccgccataaaaaaacaatggtcaagaaagtggggcctgactcagactgactgcctctgcatcccgtccccatcaccagcctccccctctccttgctgtcttatgacttcagggctgagacacaatcctcccggtcccttctgctgccttttttaccttgtagctagggctcagccccctctctgagtagtggttcctggcccaagttggggaataggttgatagttgtcaggtctctgctggcccagcgaaattctatccagccagttgttggaccctggcacctacaatgaaatctcaccctaccccacaccctgtaagattctatcttgggccctcatagggtccatatcctccagggcctactttccttccattctgcaaagcctgtctgcatttatccaccccccaccctgtctccctcttttttttttttttacccctttttatatatcaatttcctattttacaataaaattttgttatcacttaaaaaaaaaa

SEQ ID NO: 102 - DNA, 5192 bp, Homo sapiens
gccctgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 103 - protein, 636 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 104 - DNA, 5120 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 105 - protein, 587 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 106 - DNA, 5026 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 107 - protein, 450 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 108 - DNA, 4971 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 109 - protein, 426 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQFFNRIGVSKLHRVFHLPRVTEHLPPAEPDH

SEQ ID NO: 110 - DNA, 4738 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 111 - protein, 354 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPTWGP

SEQ ID NO: 112 - DNA, 4877 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 113 - protein, 506 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 114 - DNA, 4832 bp, Homo sapiens
ggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatgctgtacgtcggtgaccccgcacggcacctcgccacggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 115 - protein, 491 aa, Homo sapiens
MLYVGDPARHLATAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 116 - DNA, 5098 bp, Homo sapiens
gccctgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 117 - protein, 499 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVRTWGP

SEQ ID NO: 118 - DNA, 5043 bp, Homo sapiens
gccctgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 119 - protein, 475 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQFFNRIGVSKLHRVFHLPRVTEHLPPAEPDH

SEQ ID NO: 120 - DNA, 4810 bp, Homo sapiens
gccctgcctccccgcccgcgcacccgcccggaggctcgcgcgcccgcgaaggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 121 - protein, 403 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPTWGP

SEQ ID NO: 122 - protein, 555 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPPRDAQQPWPRSASQRRDEQQPQRPVHGLGVPLHSATPLPRRPQPRQDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 123 - protein, 555 aa, Homo sapiens; identical to SEQ ID NO: 122

SEQ ID NO: 124 - DNA, 4866 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatgaaaaaaaaaaaa

SEQ ID NO: 125 - protein, 540 aa, Homo sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 126 - DNA, 4953 bp, Homo sapiens
aatgtgtgctggaaggtgtccaggaagccctgctaagcatctgtcagtgtctccagcacagcaggaggctgttacaggtggcgcctgattcacatctgcaggacaggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttctacatggtgggtcagcttttttttttttttttttaactttctttctcagcattctctttggagttcaacctagcgcccatgagccaggctgaggaagctgagtgagaagccaggtgggcgggacttgttcccaggaaggccgggtggggaggaagcctagagggaaccccaggaagggcaaatccaggcaaatctgcaggaatgctctgccatgggagcagctcctcccttgccacggccaccttctctagcactgcaaggtccacagggcattgctttcctttctaggcggtggcagtcagggaacagactgaggtaggtgtaggggggtctaggccttcgtggagcaccccagggagttagtaggccccggggagacagagtctgcacaggccctttctggggccacctccatccacgaggagcagcctgagccttggtggccgaaccttgaccgtcccggagcacagcttcagggcagggaaccggagcccctggggggcctcacgggtgtgacgaggcccttcattgcaggcaggtgggccaatgggagccctcacccacgcaagccgagacaccacccagagtgcaggctgcctggccccttctggcacggccagctccacaccccctgcctagggtatgtgtggtcctaagggctaggagcttcccctactaacatctcccagaaaaagcagttaagcccctcagggcacagcaaggttagacacagcccccatccccagatcaggactccatcttgctaagtggcatcaccgtcaccagcctccccttatttaaaagcagcgactggtgttgccgcaggtacctggtctacgaagacgcaggcatccctctcccaccgtccacctccccgggggccgctgacagcacagtcgcctgggtgcacgcttgtgggggcagcaggaacggggctgtcggctctcaggggatctggctgcagccagggcgagggcctggcccttccttccagctccttccggctccttccagctgaagggcaggaagctctggccgcttagcttctagggttccatctccctagaaaggtgcccacgcccagggcatcagtcagtagcggcagcagcagcagactcggggctttcccagggtggcgcagccaccccagctgcatgtcacctcagctctccatcttattgccattttgtagatgaggaagctgagaccagaaaggctaagacccatgccccaggcaccacacccatctcttgggggctgggcacctgctacccgaggccacctcctgaagcccccactcttcccccatgttccacttcaggagccgcgggggcccatcctgacacccggggttcctcagcccagcgcagatgtgcttcagttccagagggcttgttgatttgtttcttaggtacgttacctgtccaccctgagtccagtgaggctgtcccaagagcccctgtagtgtgctcctgggaagggctgggggggctgggggggctgggagaggcccaggggcagctgtcactggaaccccagccagatgtccaaggaagccggccagaacacggagcagccagatggccccagctgcacctgtctagggagcccatgcagcctccttgcactggagaagcagctgtgaaagtagacagagttgagacttcgccgtggtcaggagaaaatgcaaattcccaggaacaagaatcctttaagtgatatgtttttataaaactaaacaaatcaacaaataaatcttgaaggcggatggttttcccagcagtgcaggggttggagggaggctgctggcactcctggggccaagggggacaggcagtggtcctgagtctgctcagagaggcaaggcagaaggagctcgccaggcaggtcagctcacatctgtccaagtcgctctggtcagaaacagcgactctcccccattcccccagcgttcccaccaggcctgggctgctgggaagcccttgctgtacccaggagcccgacccgcagtatcctggcacagagccacttgtcactcagaacagtcagtgtctccaacgcacaaacatccactcctctgttaccagttaaagcactttaatgctttaaggtgaaaacgaaatcccatccgtgtttttcgtgtaagatcgtgcttctccgagcagtattaatggacgccctccaatgacataacaactgtttttggtaatgtaatcttgggaaaatgtgttatttttttagctgtgtttcagtggggatttttgtttttgtaacataataaagtgtatgttccaatga

SEQ ID NO: 127 - protein, 565 aa, Homo sapiens
MDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 128 - DNA, 4710 bp, Mus musculus
gaggcaacgctgcagcccagccctcgccgacgccgacgcccggcccggagcagaatgagcggcagcgttggggagatggcccagacctcttcttcctcctcctccaccttcgagcacctgtggagttctctagagccagacagcacctactttgacctcccccagcccagccaagggactagcgaggcatcaggcagcgaggagtccaacatggatgtcttccacctgcaaggcatggcccagttcaatttgctcagcagtgccatggaccagatgggcagccgtgcggccccggcgagcccctacaccccggagcacgccgccagcgcgcccacccactcgccctacgcgcagcccagctccaccttcgacaccatgtctccggcgcctgtcatcccttccaataccgactaccccggcccccaccacttcgaggtcaccttccagcagtcgagcactgccaagtcggccacctggacatactccccactcttgaagaagttgtactgtcagattgctaagacatgccccatccagatcaaagtgtccacaccaccacccccgggcacggccatccgggccatgcctgtctacaagaaggcagagcatgtgaccgacattgttaagcgctgccccaaccacgagcttggaagggacttcaatgaaggacagtctgccccggctagccacctcatccgtgtagaaggcaacaacctcgcccagtacgtggatgaccctgtcaccggaaggcagagtgtggttgtgccgtatgaacccccacaggtgggaacagaatttaccaccatcctgtacaacttcatgtgtaacagcagctgtgtggggggcatgaatcggaggcccatccttgtcatcatcaccctggagacccgggatggacaggtcctgggccgccggtctttcgagggtcgcatctgtgcctgtcctggccgtgaccgcaaagctgatgaagaccattaccgggagcaacaggctctgaatgaaagtaccaccaaaaatggagctgccagcaaacgtgcattcaagcagagcccccctgccatccctgccctgggtaccaacgtgaagaagagacgccacggggacgaggacatgttctacatgcacgtgcgaggccgggagaactttgagatcttgatgaaagtcaaggagagcctagaactgatggagcttgtgccccagcctttggttgactcctatcgacagcagcagcagcagcagctcctacagaggccgagtcacctgcagcctccatcctatgggcccgtgctctccccaatgaacaaggtacacggtggtgtcaacaaactgccctccgtcaaccagctggtgggccagcctcccccgcacagctcagcagctgggcccaacctggggcccatgggctccgggatgctcaacagccacggccacagcatgccggccaatggtgagatgaatggaggccacagctcccagaccatggtttcgggatcccactgcaccccgccacccccctatcatgcagaccccagcctcgtcagttttttgacagggttggggtgtccaaactgcatcgagtgcttcacttcccaagggttgcagagcatctaccacctgcagaaccttaccatcgaggaccttggggctctgaaggtccctgaccagtaccgtatgaccatctggaggggcctacaggacctgaagcagagccatgactgcggccagcaactgctacgctccagcagcaacgcggccaccatctccatcggcggctctggcgagctgcagcggcagcgggtcatggaagccgtgcatttccgtgtgcgccacaccatcacgatccccaaccgtggaggcgcaggtgcggtgacaggtcccgacgagtgggcggactttggctttgacctgcctgactgcaagtcccgtaagcagcccatcaaagaggagttcacagagacagagagccactgaggaacgtaccttcttctcctgtccttcctctgtgagaaactgctcttggaagtgggacctgttggctgtgcccacagaaaccagcaaggaccttctgccggatgccattcctgaagggaagtcgctcatgaactaactccctcttggaaacttctggaactgcccttagctacatatacacaagggcaggtggtgagccaagtgctgagacagggagctgtccctttgtgggtgggtatgcagcacccatttgcttctcccgttctctattgaggactctgccacctccaggacagagcagcatccttcacttgctcaccctctgccacaaagtattccaacatcttctgttcctgctaaccatgcacagcccagcctctgtgtcatcagcgcttacgtacaggtcgattccactgtgtcttgaaagtgaattcagggccagagacatcttctgcaggatgtgtggacagatctgtccctaatgtaggtcattctgccgttaccccttgtctcccgagtcttgattgctggggtcagggaagactgtggcagagcaggggaagccgctggccctccgcctctagccagcaccctgaacatgctggctgtagcagcctctagggacctctctggtcagacaaagggacagaatgagtctcagactaccgaaaattgaattgtcaatatttgataaaaggttactctttctacttggtggggtcagcttgctttttcccccctctctgactctctcagcattcctttctgagatcagcctagtgtgtccacacgtacttctcaacaagtctaaaacgccgagcatcaatccaggaagggtccttacctgttaccaggatggttggaagggaaagagactcagagagagcatagccgtgggagtgcaggtcagacagaccccagctgtgaggaacatctgttctcactaagtgctcagagtctgggctctgtgcctgagtgctagcccatcctcgtggcctggaactggagtggctgctgggggccctggtcttcatgattcatccccaaagagtcagtggctagagaaacagctcctgcatgcattcagccaatggggccctgtacctgccagaagctttgtgaacttctgcaatgagagcccccagcagtccctgccaggagtggagaagcacagaggagcccctgccaacagtaaagcccaacatctgccgagtcactttggagccatcctctttaggcttggctttcattagcaaggcccaacagaggcagtgacgtccgtgggatagcctcagagtcagcactaccagggctggcgtcatatcagggctgcctcctcgaagcccagggacaatgttgccaatcttagcaatcttagcaagctctgcaaacttaggtggttaccacccatgctatgcttcatgaatctctgaggggcaggatttgggtgcacttagggtaggtgcaggcatcacattgtcagagaccagtgctgaccatacaggcctttccaacttgacagatgttgacagcttaggctctgggggggtggggggttcctgcacccagatgggccgttaacagctgcagcatcaggcttgcttcttgggtgtaggttgtggccctcccagtgagtggtaacacacttcacaaagcctgaggttgactacacacttcttgttgctgctcagatgaggaagctgaggctagacagactgagtgccctgcctcgggcatcagctcattgcagaagtgggtgttcactcctgaggtacatgctgccccatgctacctcagaaactaggcagcacattctcactcctaggcctgtgaaccccactgagatgcgcttgcgttctgggatctcacataagtatgtctcaggcattgtccaggagggaccatcctaagcgccccaccacatgctcctgggaaggaggagtggttaggaggagtggttgtcaccaggcatctgaggagggaagagcccccctccagcaaggacccagggcttgtgtctccctagaccctgcctcaagtgccaaagctgtctcgtgagcttccaggatcctgacaggcctggagggaactgcaaagggccatctgccaggaaataaacgtcacagaggcaatgcttgcagtgcctgagaagctctccaggaaccagcctttgggtctgaaccaaactttgttctacaaaacacagaaagcaagagaaagcaaatcttccagccaccaactttcccaggagcactggagtactagtttggaaacaagtttgggggtgccctggaagacatctgttgagcaagggcaggttgagcagggctgtaaaagcaggccactccagcctcagtctgtatggtcccatccagctttgtgcatccaattaacagcagctcccatgtcccttcctggccttgcttaccgtgcctgacagctctaccttgggctgctttgagcttgtgagttcgcagaaccagcacccctacgcaagaatcctgcaagggtcaaaagttgccacttagttgcatttcagatgggagacaaaaaccaaaactaaattgtccatgtttcaatgtgatgaaatgcttctccaagcagtattgatggatacagtctagtgactctattaactgttttgggtgatgtcattttagaaaaatgtgttattttttttagctgtgtttcggtgggaatttttgtttttgtaatataataaaaatcacatgttcccat

SEQ ID NO: 129 - protein, 631 aa, Mus musculus
MAQTSSSSSSTFEHLWSSLEPDSTYFDLPQPSQGTSEASGSEESNMDVFHLQGMAQFNLLSSAMDQMGSRAAPASPYTPEHAASAPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDIVKRCPNHELGRDFNEGQSAPASHLIRVEGNNLAQYVDDPVTGRQSVVVPYEPPQVGTEFTTILYNFMCNSSCVGGMNRRPILVIITLETRDGQVLGRRSFEGRICACPGRDRKADEDHYREQQALNESTTKNGAASKRAFKQSPPAIPALGTNVKKRRHGDEDMFYMHVRGRENFEILMKVKESLELMELVPQPLVDSYRQQQQQQLLQRPSHLQPPSYGPVLSPMNKVHGGVNKLPSVNQLVGQPPPHSSAAGPNLGPMGSGMLNSHGHSMPANGEMNGGHSSQTMVSGSHCTPPPPYHADPSLVSFLTGLGCPNCIECFTSQGLQSIYHLQNLTIEDLGALKVPDQYRMTIWRGLQDLKQSHDCGQQLLRSSSNAATISIGGSGELQRQRVMEAVHFRVRHTITIPNRGGAGAVTGPDEWADFGFDLPDCKSRKQPIKEEFTETESH

SEQ ID NO: 130 - DNA, 4756 bp, Mus musculus
gttgttggatgcagccagttgacagaaatgagggagatgggcagggtgagaatgccaactctcagtccgcacgcctctgagcatcctccgctcctgccttcctagccacagagcctcaacccctcagtccaccccaccgggcagccaccagtctacccctaccccacctagccacccagacccatgcctcgtcccgcggcacaccagctcctcagcgtgtgcagacccccacgagcctaccatgctttacgtcggtgaccccatgagacacctcgccacggcccagttcaatttgctcagcagtgccatggaccagatgggcagccgtgcggccccggcgagcccctacaccccggagcacgccgccagcgcgcccacccactcgccctacgcgcagcccagctccaccttcgacaccatgtctccggcgcctgtcatcccttccaataccgactaccccggcccccaccacttcgaggtcaccttccagcagtcgagcactgccaagtcggccacctggacatactccccactcttgaagaagttgtactgtcagattgctaagacatgccccatccagatcaaagtgtccacaccaccacccccgggcacggccatccgggccatgcctgtctacaagaaggcagagcatgtgaccgacattgttaagcgctgccccaaccacgagcttggaagggacttcaatgaaggacagtctgccccggctagccacctcatccgtgtagaaggcaacaacctcgcccagtacgtggatgaccctgtcaccggaaggcagagtgtggttgtgccgtatgaacccccacaggtgggaacagaatttaccaccatcctgtacaacttcatgtgtaacagcagctgtgtggggggcatgaatcggaggcccatccttgtcatcatcaccctggagacccgggatggacaggtcctgggccgccggtctttcgagggtcgcatctgtgcctgtcctggccgtgaccgcaaagctgatgaagaccattaccgggagcaacaggctctgaatgaaagtaccaccaaaaatggagctgccagcaaacgtgcattcaagcagagcccccctgccatccctgccctgggtaccaacgtgaagaagagacgccacggggacgaggacatgttctacatgcacgtgcgaggccgggagaactttgagatcttgatgaaagtcaaggagagcctagaactgatggagcttgtgccccagcctttggttgactcctatcgacagcagcagcagcagcagctcctacagaggccgagtcacctgcagcctccatcctatgggcccgtgctctccccaatgaacaaggtacacggtggtgtcaacaaactgccctccgtcaaccagctggtgggccagcctcccccgcacagctcagcagctgggcccaacctggggcccatgggctccgggatgctcaacagccacggccacagcatgccggccaatggtgagatgaatggaggccacagctcccagaccatggtttcgggatcccactgcaccccgccacccccctatcatgcagaccccagcctcgtcagttttttgacagggttggggtgtccaaactgcatcgagtgcttcacttcccaagggttgcagagcatctaccacctgcagaaccttaccatcgaggaccttggggctctgaaggtccctgaccagtaccgtatgaccatctggaggggcctacaggacctgaagcagagccatgactgcggccagcaactgctacgctccagcagcaacgcggccaccatctccatcggcggctctggcgagctgcagcggcagcgggtcatggaagccgtgcatttccgtgtgcgccacaccatcacgatccccaaccgtggaggcgcaggtgcggtgacaggtcccgacgagtgggcggactttggctttgacctgcctgactgcaagtcccgtaagcagcccatcaaagaggagttcacagagacagagagccactgaggaacgtaccttcttctcctgtccttcctctgtgagaaactgctcttggaagtgggacctgttggctgtgcccacagaaaccagcaaggaccttctgccggatgccattcctgaagggaagtcgctcatgaactaactccctcttggaaacttctggaactgcccttagctacatatacacaagggcaggtggtgagccaagtgctgagacagggagctgtccctttgtgggtgggtatgcagcacccatttgcttctcccgttctctattgaggactctgccacctccaggacagagcagcatccttcacttgctcaccctctgccacaaagtattccaacatcttctgttcctgctaaccatgcacagcccagcctctgtgtcatcagcgcttacgtacaggtcgattccactgtgtcttgaaagtgaattcagggccagagacatcttctgcaggatgtgtggacagatctgtccctaatgtaggtcattctgccgttaccccttgtctcccgagtcttgattgctggggtcagggaagactgtggcagagcaggggaagccgctggccctccgcctctagccagcaccctgaacatgctggctgtagcagcctctagggacctctctggtcagacaaagggacagaatgagtctcagactaccgaaaattgaattgtcaatatttgataaaaggttactctttctacttggtggggtcagcttgctttttcccccctctctgactctctcagcattcctttctgagatcagcctagtgtgtccacacgtacttctcaacaagtctaaaacgccgagcatcaatccaggaagggtccttacctgttaccaggatggttggaagggaaagagactcagagagagcatagccgtgggagtgcaggtcagacagaccccagctgtgaggaacatctgttctcactaagtgctcagagtctgggctctgtgcctgagtgctagcccatcctcgtggcctggaactggagtggctgctgggggccctggtcttcatgattcatccccaaagagtcagtggctagagaaacagctcctgcatgcattcagccaatggggccctgtacctgccagaagctttgtgaacttctgcaatgagagcccccagcagtccctgccaggagtggagaagcacagaggagcccctgccaacagtaaagcccaacatctgccgagtcactttggagccatcctctttaggcttggctttcattagcaaggcccaacagaggcagtgacgtccgtgggatagcctcagagtcagcactaccagggctggcgtcatatcagggctgcctcctcgaagcccagggacaatgttgccaatcttagcaatcttagcaagctctgcaaacttaggtggttaccacccatgctatgcttcatgaatctctgaggggcaggatttgggtgcacttagggtaggtgcaggcatcacattgtcagagaccagtgctgaccatacaggcctttccaacttgacagatgttgacagcttaggctctgggggggtggggggttcctgcacccagatgggccgttaacagctgcagcatcaggcttgcttcttgggtgtaggttgtggccctcccagtgagtggtaacacacttcacaaagcctgaggttgactacacacttcttgttgctgctcagatgaggaagctgaggctagacagactgagtgccctgcctcgggcatcagctcattgcagaagtgggtgttcactcctgaggtacatgctgccccatgctacctcagaaactaggcagcacattctcactcctaggcctgtgaaccccactgagatgcgcttgcgttctgggatctcacataagtatgtctcaggcattgtccaggagggaccatcctaagcgccccaccacatgctcctgggaaggaggagtggttaggaggagtggttgtcaccaggcatctgaggagggaagagcccccctccagcaaggacccagggcttgtgtctccctagaccctgcctcaagtgccaaagctgtctcgtgagcttccaggatcctgacaggcctggagggaactgcaaagggccatctgccaggaaataaacgtcacagaggcaatgcttgcagtgcctgagaagctctccaggaaccagcctttgggtctgaaccaaactttgttctacaaaacacagaaagcaagagaaagcaaatcttccagccaccaactttcccaggagcactggagtactagtttggaaacaagtttgggggtgccctggaagacatctgttgagcaagggcaggttgagcagggctgtaaaagcaggccactccagcctcagtctgtatggtcccatccagctttgtgcatccaattaacagcagctcccatgtcccttcctggccttgcttaccgtgcctgacagctctaccttgggctgctttgagcttgtgagttcgcagaaccagcacccctacgcaagaatcctgcaagggtcaaaagttgccacttagttgcatttcagatgggagacaaaaaccaaaactaaattgtccatgtttcaatgtgatgaaatgcttctccaagcagtattgatggatacagtctagtgactctattaactgttttgggtgatgtcattttagaaaaatgtgttattttttttagctgtgtttcggtgggaatttttgtttttgtaatataataaaaatcacatgttcccatggt

SEQ ID NO: 131 - protein, 590 aa, Mus musculus
MLYVGDPMRHLATAQFNLLSSAMDQMGSRAAPASPYTPEHAASAPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDIVKRCPNHELGRDFNEGQSAPASHLIRVEGNNLAQYVDDPVTGRQSVVVPYEPPQVGTEFTTILYNFMCNSSCVGGMNRRPILVIITLETRDGQVLGRRSFEGRICACPGRDRKADEDHYREQQALNESTTKNGAASKRAFKQSPPAIPALGTNVKKRRHGDEDMFYMHVRGRENFEILMKVKESLELMELVPQPLVDSYRQQQQQQLLQRPSHLQPPSYGPVLSPMNKVHGGVNKLPSVNQLVGQPPPHSSAAGPNLGPMGSGMLNSHGHSMPANGEMNGGHSSQTMVSGSHCTPPPPYHADPSLVSFLTGLGCPNCIECFTSQGLQSIYHLQNLTIEDLGALKVPDQYRMTIWRGLQDLKQSHDCGQQLLRSSSNAATISIGGSGELQRQRVMEAVHFRVRHTITIPNRGGAGAVTGPDEWADFGFDLPDCKSRKQPIKEEFTETESH

SEQ ID NO: 132 - DNA, 4468 bp, Mus musculus
gttgttggatgcagccagttgacagaaatgagggagatgggcagggtgagaatgccaactctcagtccgcacgcctctgagcatcctccgctcctgccttcctagccacagagcctcaacccctcagtccaccccaccgggcagccaccagtctacccctaccccacctagccacccagacccatgcctcgtcccgcggcacaccagctcctcagcgtgtgcagacccccacgagcctaccatgctttacgtcggtgaccccatgagacacctcgccacggcccagttcaatttgctcagcagtgccatggaccagatgggcagccgtgcggccccggcgagcccctacaccccggagcacgccgccagcgcgcccacccactcgccctacgcgcagcccagctccaccttcgacaccatgtctccggcgcctgtcatcccttccaataccgactaccccggcccccaccacttcgaggtcaccttccagcagtcgagcactgccaagtcggccacctggacatactccccactcttgaagaagttgtactgtcagattgctaagacatgccccatccagatcaaagtgtccacaccaccacccccgggcacggccatccgggccatgcctgtctacaagaaggcagagcatgtgaccgacattgttaagcgctgccccaaccacgagcttggaagggacttcaatgaaggacagtctgccccggctagccacctcatccgtgtagaaggcaacaacctcgcccagtacgtggatgaccctgtcaccggaaggcagagtgtggttgtgccgtatgaacccccacaggtgggaacagaatttaccaccatcctgtacaacttcatgtgtaacagcagctgtgtggggggcatgaatcggaggcccatccttgtcatcatcaccctggagacccgggatggacaggtcctgggccgccggtctttcgagggtcgcatctgtgcctgtcctggccgtgaccgcaaagctgatgaagaccattaccgggagcaacaggctctgaatgaaagtaccaccaaaaatggagctgccagcaaacgtgcattcaagcagagcccccctgccatccctgccctgggtaccaacgtgaagaagagacgccacggggacgaggacatgttctacatgcacgtgcgaggccgggagaactttgagatcttgatgaaagtcaaggagagcctagaactgatggagcttgtgccccagcctttggttgactcctatcgacagcagcagcagcagcagctcctacagaggccttttttgacagggttggggtgtccaaactgcatcgagtgcttcacttcccaagggttgcagagcatctaccacctgcagaaccttaccatcgaggaccttggggctctgaaggtccctgaccagtaccgtatgaccatctggaggggcctacaggacctgaagcagagccatgactgcggccagcaactgctacgctccagcagcaacgcggccaccatctccatcggcggctctggcgagctgcagcggcagcgggtcatggaagccgtgcatttccgtgtgcgccacaccatcacgatccccaaccgtggaggcgcaggtgcggtgacaggtcccgacgagtgggcggactttggctttgacctgcctgactgcaagtcccgtaagcagcccatcaaagaggagttcacagagacagagagccactgaggaacgtaccttcttctcctgtccttcctctgtgagaaactgctcttggaagtgggacctgttggctgtgcccacagaaaccagcaaggaccttctgccggatgccattcctgaagggaagtcgctcatgaactaactccctcttggaaacttctggaactgcccttagctacatatacacaagggcaggtggtgagccaagtgctgagacagggagctgtccctttgtgggtgggtatgcagcacccatttgcttctcccgttctctattgaggactctgccacctccaggacagagcagcatccttcacttgctcaccctctgccacaaagtattccaacatcttctgttcctgctaaccatgcacagcccagcctctgtgtcatcagcgcttacgtacaggtcgattccactgtgtcttgaaagtgaattcagggccagagacatcttctgcaggatgtgtggacagatctgtccctaatgtaggtcattctgccgttaccccttgtctcccgagtcttgattgctggggtcagggaagactgtggcagagcaggggaagccgctggccctccgcctctagccagcaccctgaacatgctggctgtagcagcctctagggacctctctggtcagacaaagggacagaatgagtctcagactaccgaaaattgaattgtcaatatttgataaaaggttactctttctacttggtggggtcagcttgctttttcccccctctctgactctctcagcattcctttctgagatcagcctagtgtgtccacacgtacttctcaacaagtctaaaacgccgagcatcaatccaggaagggtccttacctgttaccaggatggttggaagggaaagagactcagagagagcatagccgtgggagtgcaggtcagacagaccccagctgtgaggaacatctgttctcactaagtgctcagagtctgggctctgtgcctgagtgctagcccatcctcgtggcctggaactggagtggctgctgggggccctggtcttcatgattcatccccaaagagtcagtggctagagaaacagctcctgcatgcattcagccaatggggccctgtacctgccagaagctttgtgaacttctgcaatgagagcccccagcagtccctgccaggagtggagaagcacagaggagcccctgccaacagtaaagcccaacatctgccgagtcactttggagccatcctctttaggcttggctttcattagcaaggcccaacagaggcagtgacgtccgtgggatagcctcagagtcagcactaccagggctggcgtcatatcagggctgcctcctcgaagcccagggacaatgttgccaatcttagcaatcttagcaagctctgcaaacttaggtggttaccacccatgctatgcttcatgaatctctgaggggcaggatttgggtgcacttagggtaggtgcaggcatcacattgtcagagaccagtgctgaccatacaggcctttccaacttgacagatgttgacagcttaggctctgggggggtggggggttcctgcacccagatgggccgttaacagctgcagcatcaggcttgcttcttgggtgtaggttgtggccctcccagtgagtggtaacacacttcacaaagcctgaggttgactacacacttcttgttgctgctcagatgaggaagctgaggctagacagactgagtgccctgcctcgggcatcagctcattgcagaagtgggtgttcactcctgaggtacatgctgccccatgctacctcagaaactaggcagcacattctcactcctaggcctgtgaaccccactgagatgcgcttgcgttctgggatctcacataagtatgtctcaggcattgtccaggagggaccatcctaagcgccccaccacatgctcctgggaaggaggagtggttaggaggagtggttgtcaccaggcatctgaggagggaagagcccccctccagcaaggacccagggcttgtgtctccctagaccctgcctcaagtgccaaagctgtctcgtgagcttccaggatcctgacaggcctggagggaactgcaaagggccatctgccaggaaataaacgtcacagaggcaatgcttgcagtgcctgagaagctctccaggaaccagcctttgggtctgaaccaaactttgttctacaaaacacagaaagcaagagaaagcaaatcttccagccaccaactttcccaggagcactggagtactagtttggaaacaagtttgggggtgccctggaagacatctgttgagcaagggcaggttgagcagggctgtaaaagcaggccactccagcctcagtctgtatggtcccatccagctttgtgcatccaattaacagcagctcccatgtcccttcctggccttgcttaccgtgcctgacagctctaccttgggctgctttgagcttgtgagttcgcagaaccagcacccctacgcaagaatcctgcaagggtcaaaagttgccacttagttgcatttcagatgggagacaaaaaccaaaactaaattgtccatgtttcaatgtgatgaaatgcttctccaagcagtattgatggatacagtctagtgactctattaactgttttgggtgatgtcattttagaaaaatgtgttattttttttagctgtgtttcggtgggaatttttgtttttgtaatataataaaaatcacatgttcccatggt

SEQ ID NO: 133 - protein, 494 aa, Mus musculus
MLYVGDPMRHLATAQFNLLSSAMDQMGSRAAPASPYTPEHAASAPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDIVKRCPNHELGRDFNEGQSAPASHLIRVEGNNLAQYVDDPVTGRQSVVVPYEPPQVGTEFTTILYNFMCNSSCVGGMNRRPILVIITLETRDGQVLGRRSFEGRICACPGRDRKADEDHYREQQALNESTTKNGAASKRAFKQSPPAIPALGTNVKKRRHGDEDMFYMHVRGRENFEILMKVKESLELMELVPQPLVDSYRQQQQQQLLQRPFLTGLGCPNCIECFTSQGLQSIYHLQNLTIEDLGALKVPDQYRMTIWRGLQDLKQSHDCGQQLLRSSSNAATISIGGSGELQRQRVMEAVHFRVRHTITIPNRGGAGAVTGPDEWADFGFDLPDCKSRKQPIKEEFTETESH

SEQ ID NO: 134 - DNA, 2880 bp, Homo sapiens
cactgcatgtgtattcgtgagttcgcggttgaacaactgttcctttactctgctccctgtctttgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 135 - DNA, 3303 bp, Homo sapiens
gctgtgggaagcccagttcccgggcccccgagcctcggctcccgggcctgaccgcgctgggatctccccggccgcgctccccttccgcgcgctcctcacatctctcccgtgctgccgccgggccgaggcccgttcgcgtggcccgcggacccattgtgtcccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtttggcggcggcgcgtaattttttccccctcttccgcctacacccgctgcgtctcctggtgtctcgttcctttccctttaccggagtcgattgcctcactgcatgtgtattcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 136 - DNA, 2911 bp, Homo sapiens
caattctgggtacgtacaacttctggggcctgcaaattattggagagtgagtgaggggcaacgaaagatagacataaaagggcgcgtctcgaaaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 137 - DNA, 2919 bp, Homo sapiens
gccgtcctccggccccggccgcgctgcgctcacgccggccgggccgggaatttggagaggatccctggtcgcgcggcagcggcggcggcgcgcgggtgagcgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 138 - DNA, 2911 bp, Homo sapiens
gccgtcctccggccccggccgcgctgcgctcacgccggccgggccgggaatttggagaggatccctggtcgcgcggcagcggcggcggcgcgcgggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 139 - DNA, 3190 bp, Homo sapiens
gctgtgggaagcccagttcccgggcccccgagcctcggctcccgggcctgaccgcgctgggatctccccggccgcgctccccttccgcgcgctcctcacatctctcccgtgctgccgccgggccgaggcccgttcgcgtggcccgcggacccattgtgtcccccgcgccggcggggcgacccctgcgggagctggaggacgaccgctggcgctgctctccaaggcgcctggtggagcgggtctcgcgggcgggggaccccggcgccccgggcccctccacatcccgcacgggttttcttctcggccccagcaagcctctttggggtcgaggtcaaggaaagttcgcaccgagatcccctctaatttattcaaaggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 140 - DNA, 3188 bp, Homo sapiens
cactgcatgtgtattcgtgagttcgcggttgaacaactgttcctttactctgctccctgtctttgttagtgtttctcggggttgtttctgtaggaaggtgggggtggtgggcgtgagagacagatgtgggcttgtttttctagttgctgaaactgtatgaaggctttaaagggagaacgttttcttgatgtgctttaggaggggaggaggaacaaatgcctgccagatctcacagctacagtagctgagcttttgtttattttgaagagcatgcaatttttaaatacacggtgcaagataaccagtaaaggcgcgttccttctgaaaattgaggccggtctcagaaccatctcctgagaaagcatccttttcgtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 141 - DNA, 3002 bp, Homo sapiens
agatcaatccaggctccaggagaaagcaggcgggcgggcggagaaaggagaggccgagcggctcaacccgggccgaggctcggggagcggagagtggcgcagcgcccggccgtccggacccgggccgcgagaccccgctcgcccggccactcgtgctcccacacggacgggcgcgccgccaacccggtgctgactgggttacttttttaaacactaggaatggtaatttctactcttctggacttcaaactaagaagttaaagagacttctctgtaaataaacaaatctcttctgctgtccttttgcatttggagacagctttatttcaccatatccaaggagtataactagtgctgtcattatgaatgtgacaagtttattttcctttacaagtccagctgtgaagagacttcttgggtggaaacagggcgatgaagaagaaaaatgggcagagaaagctgttgatgctttggtgaaaaaactgaagaaaaagaaaggtgccatggaggaactggaaaaggccttgagctgcccagggcaaccgagtaactgtgtcaccattccccgctctctggatggcaggctgcaagtctcccaccggaagggactgcctcatgtcatttactgccgtgtgtggcgctggcccgatcttcagagccaccatgaactaaaaccactggaatgctgtgagtttccttttggttccaagcagaaggaggtctgcatcaatccctaccactataagagagtagaaagccctgtacttcctcctgtgctggttccaagacacagcgaatataatcctcagcacagcctcttagctcagttccgtaacttaggacaaaatgagcctcacatgccactcaacgccacttttccagattctttccagcaacccaacagccacccgtttcctcactctcccaatagcagttacccaaactctcctgggagcagcagcagcacctaccctcactctcccaccagctcagacccaggaagccctttccagatgccagctgatacgcccccacctgcttacctgcctcctgaagaccccatgacccaggatggctctcagccgatggacacaaacatgatggcgcctcccctgccctcagaaatcaacagaggagatgttcaggcggttgcttatgaggaaccaaaacactggtgctctattgtctactatgagctcaacaatcgtgtgggtgaagcgttccatgcctcctccacaagtgtgttggtggatggtttcactgatccttccaacaataagaaccgtttctgccttgggctgctctccaatgttaaccggaattccactattgaaaacaccaggcggcatattggaaaaggagttcatctttattatgttggaggggaggtgtatgccgaatgccttagtgacagtagcatctttgtgcaaagtcggaactgcaactaccatcatggatttcatcctactactgtttgcaagatccctagtgggtgtagtctgaaaatttttaacaaccaagaatttgctcagttattggcacagtctgtgaaccatggatttgagacagtctatgagcttacaaaaatgtgtactatacgtatgagctttgtgaagggctggggagcagaataccaccgccaggatgttactagcaccccctgctggattgagatacatctgcacggccccctccagtggctggataaagttcttactcaaatgggttcacctcataatcctatttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaagaacatcccagtttgaattcatttcaaactttttaaatttttttgtactatgtttggttttattttccttctgttaatcttttgtattcacttatgctctcgtacattgagtacttttattccaaaactagtgggttttctctactggaaattttcaataaacctgtcattattgcttactttgattaaaaa

SEQ ID NO: 142 - protein, 465 aa, Homo sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 143 - DNA, 3040 bp, Mus musculus
agatcaatccaggctcggggagcgagcgggcgcaccaaggcgaggccggggccgaggcgcggggacggcggcccggagctaagcagagcgcggggacggcggccgggagcggatcggagcacgggacccggcgccgggtctcgtgcgtccctgcggatgggcgcgccgccgagccggcgctaactgggatcctcgctggaacaggagggacagtattttctacctttccaaaccgcagaccaagaagctaaggagaatctatgtaaatatactgaaatctctgttggctctgcgcccaacaccccggagctggcacctcaccctgtctgaggagcgtgtagaactagaccagccgctatgaatgtgaccagcttgttttcattcacaagtccagctgtgaagagactccttgggtggaaacagggcgatgaagaagagaaatgggcagagaaagctgtggacgctttggtgaagaaactgaagaagaagaaaggggccatggaagagctggagaaggccctgagctgccctggacagccgagtaactgcgtcaccattcctcgctccctggatggcaggttgcaggtgtcccaccggaagggactacctcatgtcatttattgccgtgtgtggcgctggcccgacctccagagccaccatgaactgaagcctctggaatgctgtgagttcccatttggttccaagcagaaggaggtctgcatcaacccctaccactataagcgagtggagagcccggttctcccgccggtgctggttccgaggcacagcgagtacaatcctcagcacagccttctggctcagttccgcaacctgggacaaaatgagcctcacatgccactgaacgccacgttcccagactctttccagcagcccaacagccacccgttcccccactcccccaacagcagctaccccaactctcctggcggcagcagcagcacctaccctcactccccaaccagctcagacccgggcagcccttttcagatgccagctgacacacccccacctgcttacctgcctcctgaagaccccatggcccaggatggctctcagcccatggacacgaacatgatggcgcctccactgcccgctgaaatcagcagaggagatgttcaggcagttgcttacgaggaaccaaaacactggtgctctattgtgtactatgagctcaacaaccgtgtgggtgaagcgttccacgcctcgtccaccagcgtgctggtggatggtttcacagatccgtccaacaataagaaccgcttctgccttggcttgctctccaacgttaaccggaattccactattgaaaacaccaggcgacatattgggaaaggagtccacctttattacgttggaggagaggtgtatgcggaatgcctcagtgacagcagcatcttcgtgcagagccggaactgcaactaccaccacggctttcaccccaccaccgtctgcaagatccccagcgggtgcagcttgaaaatcttcaacaaccaagagtttgctcagctactggcgcagtctgtgaaccacgggttcgagaccgtgtatgaactcaccaaaatgtgcactattcggatgagcttcgtgaagggttggggagccgaataccaccggcaggatgttaccagcaccccctgctggattgagatccatctgcatggccctctccagtggctggataaggttctgacccagatgggctcaccccacaatcctatttcatccgtgtcttaaaagacctgtggcttccgtctcttgcaaactatcgagccttgcatgtacttgaaggatggacaagtcagacaggatggagacctgacgaaggagccacgataatacttgacctctgtgaccaactattggattgagaaactgacaagccttggttgatagcaagaaccctttcagtttacattgtgacattctgttgtaaaaatcaactaaaatgctgactttcagcaggacttttgtgtatagttaaaaaaaaaagagatggccaagccagggacaaattatctattaggaaaaaagaaaaaaatgattgtaatcaatccttttgtgtggggtgttggcagaaggttggcgctgatagtctttctgaagtgggctttcatcaggctcagagcccacgttgaatcatcttctcatgggttttcttaatattttaaaactacttgtttagaaatgaatgggttttttgtttgtttttaaagtacaggttaatcgttatgacatgcatagtaatctttctgaaactgtatgctggctgtattactgtcagaatgatggcaggcatatgctctttgctaaatatgtatatacagaatatttggaggttatgaatagtctaaatggctagtgggtttacagagtatctgaggggcggggtcgggaagaaaacgacggctgcaaatgtagactataccgtaaagctcagcttgctgccttaaacagacaagctggtgtctgaatttgctgtgtttcagtttttgtagagttttatctgacttcttttcttctgtcttatccgctccacggcacagttaagcagctggttaattcctctaactgtgagagcagatgagtaattccttctgttcgcaaatcaactggcttcgtgtttcagtacccagtatatgaaaagcttgaattgaatgagcagtttttatggagtttacagtacagacataggctttgatttccaaataaattgtttgccaaacctggtaactctgttcattattcgcaggattaaagatctctctattggaatccatttcaaaggttgttttttttgtttttgtttttgttttttgttttattttgatttgtttttttttgtactatttggtttcttttcttctgttaatttttttattctcctttgctcttatacagcgagtacttttattccaacactagcagggtttttctctactggaaatttttaaataaaacctgtcattattgcttactttgattaaaaaaaaaaaaaaaaaaaaaaaaaaaaaaaaaaaaa

SEQ ID NO: 144 - protein, 465 aa, Mus musculus
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGGSSSTYPHSPTSSDPGSPFQMPADTPPPAYLPPEDPMAQDGSQPMDTNMMAPPLPAEISRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 145 - DNA, 6464 bp, Homo sapiens
gaaacacagactgggagcgggcgggagcgggagcgcggcgcacgccccgggccggcccagccagcgagcgagcgagcggcgagccgggaggaggagggtggcggggcggtgaggccgcagaggcggagggatctgcgcatcaaagctagcgaggcgagcgaagtttggccgggggttggactttccttcccggaggcggcacccaaacagctaccccgtgcggaaacccaaacttctgctgccacttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaa

SEQ ID NO: 146 - protein, 425 aa, Homo sapiens
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 147 - DNA, 5997 bp, Homo sapiens
aaatatgagcttgtgcttgctggaggaggatgacagaggagcctgctgctgagttcactggtgctggggttaggtcactgctgggctgaagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 148 - protein, 320 aa, Homo sapiens
MELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 149 - DNA, 5808 bp, Homo sapiens
acaaacatgtcttgcctgcaccctaggcaaacgtggaaaggcgcagctctggtacaccggaaagcatggtggatggggaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 150 - protein, 381 aa, Homo sapiens
MSCLHPRQTWKGAALVHRKAWWMGRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 151 - DNA, 5441 bp, Homo sapiens
cttctcagatcctttgcgggtagccctggcgtcccgcggagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaagctcctgtgccaggagctcagtctga

SEQ ID NO: 152 - protein, 230 aa, Homo sapiens
MNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 153 - DNA, 5090 bp, Mus musculus
ggcggcacccaaacagctaccccgtgcggaaacccaaactttctactgccacttggagtctcgcggccgccgcctccgccccgcgcgtccggggcctgcccgtcagtccgtcggtccgcgtggagcagctcgggcgccgccgtgctcccgatccccgcagctgcagcgccgcagtcctggcccggacgcccgggcaagttctccagagttaaaagcgaagttcgggcgaggcgcgggccgagctgcctctgagcgcccccggcgtccccagtgcgcccagccccgccgggggcgccggtgacccttcggtgccagccatgtcgtccatcctgcccttcacccccccgatcgtgaagcgcctgctgggttggaagaagggcgagcagaacgggcaggaggagaagtggtgcgagaaggcggtcaagagcttggtgaagaagctcaagaagacggggcagttggacgagctggagaaggccatcaccacgcagaacgtgaacaccaagtgcattaccatccccaggtcactggatggtcggctgcaggtgtcccatcggaaggggctccctcacgttatctactgccgcctgtggcgatggcccgacctgcacagccaccatgaattacgggccatggagctctgtgagtttgccttcaacatgaagaaggatgaagtgtgtgtaaatccttaccactatcagagagtagagacgccagttctacctccagtgttggtgccacgccacaccgagatcccggccgagttccccccactggatgactacagccattccattcccgagaacactaacttccctgctggcattgagccccagagcaatattccagaaaccccacctcctggctacctgagtgaagatggagaaaccagtgaccaccagatgaaccacagcatggacgcaggttctccaaacctctccccgaatccgatgtccccagcacacaataacttggacctacagccagtcacctactgtgagccggccttctggtgctccatctcctactacgagctgaaccagcgagttggggagacattccacgcctcacagccatccatgacagtagatggcttcactgacccctccaactcggagcgcttctgcctgggcctactgtccaatgtcaaccggaatgcagccgtggaacttacaaggcgacacattgggagaggtgtgcggctctactacatcggaggggaggtctttgcggagtgcctcagtgacagtgctattttcgtccagtctcccaactgcaaccagcgctatggctggcacccggccactgtctgcaagatcccaccaggctgcaacctgaagatcttcaacaaccaggaatttgctgccctcctagctcagtctgtcaaccagggctttgaggctgtctaccagctgacgcgcatgtgcaccatccgtatgagcttcgtcaaaggctggggagcagagtacaggagacagacagtgaccagcaccccctgctggattgagctacacctgaatggacccttgcagtggcttgacaaggtcctcacccagatgggttccccgagcatccgctgttccagtgtgtcttagagacactaggagtaaagggagcgggttggggagggcgggcttggggaaaatgaccttggaagagaactccatccaacttggtcttgtcaaagaacaccgattccactcaactaaggcaccagcctgtttctgagaccacagaagaaaaccccagggatggatttatgaacagctgtgtctgctacatacacgtgcccctgtctgaaggccaagtgatggcttctgttctggtggcttgaactaacaggtggtgtatcgccacctgactccttgtttaatgacagaggtctgggatgtcacagtccaaaaggaaagtgcctttctccatggctggagtatggagtttacctttggagaagttgtaatggagcatgccctgtcccaccactctcagagagggtgtacctgtcaaactggatggcctacataggtactcccccctacccctaggatgcagagagacgggaacacgccggagggtagagctggggagaacccattcttccttggaaggatccgctgaaggtcagcgtataggtgatgtacagttcctaatatcacatcagtctcagagtgttcacaggaagcagcaagggcactcgtggagtatgtgtcctgggtgaggtggcaccacaccgaatgaatgcatctctgggagctggcaccacaaccctgatgtataggctgtgttggtttatggagacaagttgcatcaatgaattcacctagcataggctctttgaaatgtcctctgtttgataaaaaacaatcctgggtacgtatgttggctggaaaaccacaatggaccctgccactgcttcttgccctgaggtttggaagctgagagttatagaagccaattcaccaggaggtaagacatcccaggctgacatgggcaaatgaaaagggctattaaaatttttttacaccttggaaaattgcaggcttggtgcagagcgctctgtcatcttcaccctgggatgtaggattacctagctatggtaaaggattgccacagcaaactgtgacactgtgtaatgagcactgttcccagcggcaattacagagaaaacgagtgtaaattatttcaactggaaaaaagtccctttcttggctgttttagaacagggtacacaggatcgccacctgcaactggtactcgcttcttggctgctgcttctgttgtgaaaagacgagcccatgtttctgcatggatttcccatggaagtcctgtcctgctacagaggggaagaaagtgtaccctccaatgtgataaatcttctgatgcccccagactcttggagcacatcctggtgcccctcctgcaggagcctgtggcatatttccagctgggcatgctgatcctccttgagacacagatgcctgtgtgagtctccgttgatacaattctgaacccctcaggttctctgaaagggcacagaccatgggcgtgaacattgtgccgtacctgagatggtctgtggactgctgcttcagacacacgagtcctcggaactgcctggctgcctgtcacgcatgctctgagtcagaacacaccaacgctctgctgtggctcctagggaagcattcatggtcctctgttatcagcaggggtttatgtcacttgctgtccggtttcctaggggcttcctgtgccccttccccagctatcctccaggtggctagggacagtctattctgctgcaactggaaagtagagggaaccggcactgctcagagcagatggcggcttctggaggcacacagtgggagtacaccccttcatgttattggccagttgctggagaatgctgtaggagaaaattctaggcaggtctactcttggcatccctgagagtcaaaggcttggagtctaggaaaggtcacaccatgatggagaacacaggtcatttgggtacgtgtaatcaaagtgccctcccaaatcagttctccttttcgtatgaacagcatctctacttttaaagaggagttgaggatcgagaagatgacagtgcagcagtgggtgtggcctgactacatgtgctgttccagccctgggtgcccactgacaccgacccccaggcagaggcctttgtcttcagcactcctgagaagttggctctttaccccttctcctctgctgcccctccttcctgctggttcaggtagccccagccacgtgggttagagtcctgtgctggcctgccatggcagctggctaccttccagaccaactgtagagatacctggcattttgaagaaagcctagactggagagcagggcctctcttgggaaggacacaaggcgggcaaggctgctggcagacttctccactgacctgagtgtgctttttttttcccctaaatgtattgcatcaagcctcagtgcttatggagtgcagtggtcttcatcttccccaacttgcttctcagagctgggatgtattccagagcctgatgtttttattcaaaccacagaaaagttttctttaagtagcctgtgcagtcatgcatgtgcctgagttgtctggagcagaggcaaacatctgacttcattcttagccccaagctgccatttctgagtccttgagaggctgagaaggctctagctttgtactgtattcttactgtgtgactagatgcgtgagcgctttacattagaaggaacctggttagagctcgctcctcctgtctttgtgtggcatttgtgttccattaccggcccctttaagtaacggccttcacagcaccttcccagtgggtagaaagccacacaccaggatgtgggtcaaccatgaagatgtggcattgcagacgggggaacatgtggatgcatggctatcgccctgaacagtccctgcagctacttgtgttaacacagaactgatgtttagcattctgccgctttcgtatttatgtaacaattccttaaagccattcaaatggctaactatttaatttctttaggacagttgtaaaggtctctctcctgaggacaatgacttggaagaactggggcacagccagtcccagacactggtggaggctgcagtgactttttttggctcaagatccacaagcattagagtagactgggccaacaagtcaacaagtggtggcgtgtgcaaacgggctgccctagtcaagcccagtcccttcaacagtatgtctgatgcaccacaggccctccctactggaagtgggaacttcaaatggaaattggagccatcttttatcccagaagcctttgctgctgccagggcaagtgggctggtgtggactcttgtttaggaggctgaggttcttgtcactccttagccagccaggcctttagtgtctttgtaaaaagcatgtatttatagtgttttagatttttctaacttttgtatcttacagcattgtaccccattgttaaagagccgtgtcccctcttcttataaacgcccttctaataaacttttcaccgtaaagctcctgagacaggagcacagtctg

SEQ ID NO: 154 - protein, 425 aa, Mus musculus; identical to SEQ ID NO: 146

SEQ ID NO: 155 - DNA, 8789 bp, Homo sapiens
atgctcagtggcttctcgacaagttggcagcaacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattgatctctcaggattaacactgcagagtaatgctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtcagcctgccagtatactggggggcagccatagtgaaggactgttgcagatagcatcagggcctcagccaggacagcagcagaatggatttactggtcagccagctacttaccatcataacagcactaccacctggactggaagtaggactgcaccatacacacctaatttgcctcaccaccaaaacggccatcttcagcaccacccgcctatgccgccccatcccggacattactggcctgttcacaatgagcttgcattccagcctcccatttccaatcatcctgctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacgggcgtgagccactgtccctggcctcattgttcccttttctactttaaggaaagttttcatgtttaatcatctggggaaagtatgtgaaaaatatttgttaagaagtatctctttggagccaagccacctgtcttggtttctttctactaagagccataaagtatagaaatacttctagttgttaagtgcttatatttgtacctagatttagtcacacgcttttgagaaaacatctagtatgttatgatcagctattcctgagagcttggttgttaatctatatttctatttcttagtggtagtcatctttgatgaataagactaaagattctcacaggtttaaaattttatgtctactttaagggtaaaattatgaggttatggttctgggtgggttttctctagctaattcatatctcaaagagtctcaaaatgttgaatttcagtgcaagctgaatgagagatgagccatgtacacccaccgtaagacctcattccatgtttgtccagtgcctttcagtgcattatcaaagggaatccttcatggtgttgcctttattttccggggagtagatcgtgggatatagtctatctcatttttaatagtttaccgcccctggtatacaaagataatgacaataaatcactgccatataaccttgctttttccagaaacatggctgttttgtattgctgtaaccactaaataggttgcctataccattcctcctgtgaacagtgcagatttacaggttgcatggtctggcttaaggagagccatacttgagacatgtgagtaaactgaactcatattagctgtgctgcatttcagacttaaaatccatttttgtggggcagggtgtggtgtgtaaaggggggtgtttgtaatacaagttgaaggcaaaataaaatgtcctgtctcccagatgatatacatcttattatttttaaagtttattgctaattgtaggaaggtgagttgcaggtatctttgactatggtcatctggggaaggaaaattttacattttactattaatgctccttaagtgtctatggaggttaaagaataaaatggtaaatgtttctgtgcctggtttgatggtaactggttaatagttactcaccattttatgcagagtcacattagttcacaccctttctgagagccttttgggagaagcagttttattctctgagtggaacagagttctttttgttgataatttctagtttgctcccttcgttattgccaactttactggcattttatttaatgatagcagattgggaaaatggcaaatttaggttacggaggtaaatgagtatatgaaagcaattacctctaaagccagttaacaattattttgtaggtggggtacactcagcttaaagtaatgcatttttttttcccgtaaaggcagaatccatcttgttgcagatagctatctaaataatctcatatcctcttttgcaaagactacagagaataggctatgacaatcttgttcaagcctttccatttttttccctgataactaagtaatttctttgaacataccaagaagtatgtaaaaagtccatggccttattcatccacaaagtggcatcctaggcccagccttatccctagcagttgtcccagtgctgctaggttgcttatcttgtttatctggaatcactgtggagtgaaattttccacatcatccagaattgccttatttaagaagtaaaacgttttaatttttagcctttttttggtggagttatttaatatgtatatcagaggatatactagatggtaacatttctttctgtgcttggctatctttgtggacttcaggggcttctaaaacagacaggactgtgttgcctttactaaatggtctgagacagctatggttttgaatttttagttttttttttttaacccacttcccctcctggtctcttccctctctgataattaccattcatatgtgagtgttagtgtgcctccttttagcattttcttcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttccatgttattcaaaggagactaggcttgatattttattactgttcttttatggacaaaaggttacatagtatgcccttaagacttaattttaaccaaaggcctagcaccaccttaggggctgcaataaacacttaacgcgcgtgcgcacgcgcgcgcgcacacacacacacacacacacacacacacacaggtcagagtttaaggctttcgagtcatgacattctagcttttgaattgcgtgcacacacacacgcacgcacacactctggtcagagtttattaaggctttcgagtcatgacattatagcttttgagttggtgtgtgtgacaccaccctcctaagtggtgtgtgcttgtaattttttttttcagtgaaaatggattgaaaacctgttgttaatgcttagtgatattatgctcaaaacaaggaaattcccttgaaccgtgtcaattaaactggtttatatgactcaagaaaacaataccagtagatgattattaactttattcttggctctttttaggtccattttgattaagtgacttttggctggatcattcagagctctcttctagcctacccttggatgagtacaattaatgaaattcatattttcaaggacctgggagccttccttggggctgggttgagggtggggggttggggagtcctggtagaggccagctttgtggtagctggagaggaagggatgaaaccagctgctgttgcaaaggctgcttgtcattgatagaaggactcacgggcttggattgattaagactaaacatggagttggcaaactttcttcaagtattgagttctgttcaatgcattggacatgtgatttaagggaaaagtgtgaatgcttatagatgatgaaaacctggtgggctgcagagcccagtttagaagaagtgagttgggggttggggacagatttggtggtggtatttcccaactgtttcctcccctaaattcagaggaatgcagctatgccagaagccagagaagagccactcgtagcttctgctttggggacaactggtcagttgaaagtcccaggagttcctttgtggctttctgtatacttttgcctggttaaagtctgtggctaaaaaatagtcgaacctttcttgagaactctgtaacaaagtatgtttttgattaaaagagaaagccaactaaaaaaaaaaaaaaaaaaaa

SEQ ID NO: 156 - protein, 552 aa, Homo sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 157 - DNA, 7391 bp, Mus musculus
agtgtccttccgacaagttggcagcaacaacacggccctggtcgtcgtcgccgctgcggtaacggagcggctcgggtggcggagcccgtgttcgcgtccgtccgcccgcccgcccgccgtcctccggaggcccttcccgcgccgcgctccgctccgcggccgtccccggggcgggagcgcgtgaccggagccggcgcccgcgagcgaggccccccgcagcggggcggctccggagctccagcggcccggccggccggcgcggtccgcggcgcggcggggagagggggccgcctgggccggacgccgcgggcggggcccgggaagcgacagcgaggcgaggcgcggtgcggcgcggagcccaggtcatcctgctcaccagatgtcttgacagtttttcttgcaacattggccattggttttcactgccttcaaaagatcaaaattactccagaaattggagagttggatttaaaagaaaaaacttgaacaaatggacaatatgtctataacaaatacaccaacaagtaacgatgcctgtctgagcattgtacatagtttgatgtgtcatagacaaggtggggaaagtgaaacctttgcaaaaagagcaattgagagtttggtaaagaagctgaaagagaaaaaagatgaattggattctttaataacagctataactacaaatggagctcatcctagcaagtgtgtcaccatacagagaacattggatggacgacttcaggtggctggtcggaaaggatttcctcatgtgatctatgcccgtctgtggaggtggcctgatctacacaagaatgaactaaagcatgttaaatattgtcagtatgcgtttgacttaaaatgtgacagtgtctgtgtgaatccatatcactatgagcgggttgtctcacctggaattgatctctcaggattaacactgcagagtaatgctccaagtatgttagtgaaggatgagtacgttcacgactttgaaggacagccgtccttacccactgaaggacattcgattcaaaccatccaacacccgccaagtaatcgcgcatcaacggagacgtacagcgccccggctctgttagccccggcagagtctaacgccaccagcaccaccaacttccccaacattcctgtggcttccacaaggccagttcacaatgagcttgcattccagcctcccatttccaatcatcctgctcctgagtactggtgctccattgcttactttgaaatggacgttcaggtaggagagacgtttaaggtcccttcaagctgccctgttgtgactgtggatggctatgtggatccttcgggaggagatcgcttttgcttgggtcaactctccaatgtccacaggacagaagcgattgagagagcgaggttgcacataggcaaaggagtgcagttggaatgtaaaggtgaaggtgacgtttgggtcaggtgccttagtgaccacgcggtctttgtacagagttactacctggacagagaagctggccgagcacctggcgacgctgttcataagatctacccaagcgcgtatataaaggtcagtgtttatatgtctttgatctgcggcagtgtcaccggcagatgcagcaacaggcggccactgcgcaagctgcagctgctgctcaggcggcggccgtggcagggaacatccctggccctgggtccgtgggtggaatagctccagccatcagtctgtctgctgctgctggcatcggtgtggatgacctccggcgattgtgcattctcaggatgagctttgtgaagggctggggcccagactaccccaggcagagcatcaaggaaaccccgtgctggattgagattcaccttcaccgagctctgcagctcttggatgaagtcctgcacaccatgcccattgcggacccacagcctttagactgagatctcacaccacggacgccctaaccatttccaggatggtggactatgaaatatactcgtgtttataatctgaagatctattgcattttgttctgctctgtcttttcctaaagggttgagagatgtgtttgctgccttgctcttagcagacagaaactgaattaaaacttcttttctattttagaactttcaggtgtggctcagtgcttgaagatcagaaagatgcagttcttgctgagtcttccctgctggttctgtatggaggagtcggccagtgctgggcgctcagccctttagtgtgtgcgagcgccttgcatgccgaggagagtcagagctgctgattgtaaggctgagaagttctcacagttaagccacctgccccttagtgggcgagttattaaacgcactgtgctcacgtggcgctgggccagccagctctaccaagagcaactttactctcctttaaaaaccttttagcaacctttgattcacaatggtttttgcaagttaaacagtgaaggtgaattaaattcatactgtcttgcagacttcagggtttcttccccaagacaaaacactaatctgtgtgcatattgacaattccttacaattatcagtcaaagaaatgccatttaaaattacaatttttttaatccctaatggatgaccactatcaagatgtatactttgccctgttaaacagtaaatgaattcttctatatttctaggcacaaggttagttatttaaaaaaaaaaaaaaaagcctaggggagggatttttcccttaattcctagggagaaggttttgtataaaacactaaaagcagtgtcactctgcctgctgcttcactgttctgcaaggtggcagtacttcaactgaaataatgaatattttggaaactgctaaattctatgttaaatactgtgcagaataatggaaacagtgcagttggtaacaggtggtttggatatttttgtacttgatttgatgtgtgacttcttttcatatactgttaaaatcatgtatgttttgacattgtttaaaattcagtttttgtatcttagggcaagactgcagacttttttataccttttggttataagccctgtgtttgccatccttgatcacttggcggtgactttgtagagattgaagtggaggagttaagacacattgactgtaccacagacacacatgtatactttctacctagttactagcgtaaataaaactgagtcactatacgaagtggaattctagatttggtttttaaaatgctttccttttgcacttttgagtccagtctcagtggcaagacaccttctgctaaatgacaggtggcagccagttgtaccatgcagcgctggttccctcccactctaccaggactttcccatggacactgtgcatcatgtgtagttggttattttttgagtttttattttactgtagcaaaaaaaaaaaaaaaaacttggataaatagtgtgaataaaatcaagaccatggagatgtttttaccctgagagttttctgtgagttttaaattgcagtaggcatttgagctctggaaaccccgtgcatagcagttctctttgtgccaacagaaatgaccacgtcctgcagcctgctgcggaaggttccagaggctctgagaaaccagagtgctgcagtgactggggtccatctcagcccagcgcacacagcgtgcgttgtaaaagctgcctctgtgtcttgtcttctgtacttagggatgctttgtctcgggcctaatcttatctgtagaagtttggtgattttttttttttaaatgttgtattgacagaattataaaaagataccttctctagaaatgcttgtcttcagatccgtttcacgatggccggggaacaggagtgagaagagagagtaagctgtagtgtaacgggtttttaagacccagctcatctgaccaggcagtgctgtaacttgatgcttcctgttgtaccttatggaacctttcccatatttaatcatcttcagaaagtaggtgggaaatatttgctgggaagtatctcttcagagccaagccacttgtcttggttttcttactaagagccatagaaatgatttctggttattgatgaaatttgtaatttgcctgtcctagtcttttttcctttcacttcgctatctttgaataagacttttaaaaacttccctgagttgaaaaattttgggataaaatagtttccctagttcttagagactgattatgatgtgggtatggttctgggtgggttttttttctaagtcatagctcaaaagtctcccaagattaaatttcagtgggcacccagtttgaaaccattctacttttgtcttgtgcctttctttgcatgattaaagagaatctgtaatggtattgcctttatttgcttggaagtagattcttttctgggatagagtctaccttaatcgttgtcctttaccgcccctgctgtacagatagatgctaagccactgccgggaacttgcttttccatagacagtctttttatactgcctgaacccattgctcctgttcacagtataagttcacagacagggtgagccggccgaggcgcacacctgcagaatccagcaacaaccatgcttaactgtgtgtatttcaaagttagaaatccagttttgtggggaatggtgtggtttatattagcagctttgaaggcgaagtaactcagaggttttacagtctggagaagggaagcttcctggaatgcttgtgaagtatctgtggtggccaaatgtgtttgctcctggccttgcttgtaactggctaattgtcactcttcagatttttaaaaatttttaatgagctgagacccccttggaaggagcttgtttggagctggccagagatgtttttggtagttcctgtcttcatccggtcttcatcactgttttctttaatggtcagttagtaaagtataagttaggtcactgtcatgagtggagcaggaacaactctcccaggtgggggcctggaagggactcgttacatggagccatctgtaactagccctttaaatcctcctttgcatgacatagagaaaaggctgtgagactcctgcccaggcctttctagttttcccttctagtaaccaagcaatcgcatctctgcggtgcagtaggctgtatgtaaaaagccgtggccttactcctagcagcacccttggcagggcctttttctcagcgcagtgaggctgtgcatctggcactcctgaggaatgaaagttttcatcatcttgccttattaagcagtaaaacttttgaaaaatgagccgtttattggcaggagctatttacacaaatcagaatattataccatttctttttctctctctcctgtctctgtggacctccggggcttctgagatagacagtactgcctagccattcgaaatgcccaagccagctggggttgttgggctctcctctcccttcctccttcctcacagctcctgctcttgcgtggttagtgagcctctactcagtgtttcctgtcctcgctgctcaggcgagggaagacgacaactgatagtcttagagttcacctttctgtcgggggcggcattgttctgattgctgccatcgtctccgatccttgatgagttttatacgattgatgtggagagaatttaattgatattcatagcccatagctgctcccctctccctggtgttgtggaagatttagtttccaccgaattcactcaaaaagctgtcctgttggcaccagcaaaccacacgctcttttagaaaacatctttgcttgttttgtgtcctgaccctgctctctggcctccttcctctgtagatacttctgacctataggtgcctttatgagaattgagggtctgataccgtgccccaaggaatagctgatgcaatgagtgatgtttttcagggattttagcatcaaattaaataaatgaatgaaacttttaagtccttcttttcttttatttttttaatgcaggaaggactgaggagacgtcgggtgacgacaatcatttctctgtgttgctgtaaaggctttcacacagtttaagatgcttttctcagtagctccagagttgatgttcttgttcaacctaaagcaggctctggactcgcccagaccgttgcacttgtagtttacgacttcatgtgtcctccctcggcaagtcattcccttctctgggcctcagctgcctcgtctgtgaaatgaggggttggactattgtgccagctctggcttctaagtgaccttgcccgccctgcagcaggttgagatgcgctctttaccttttttctgctgtgtgagggggaatcttactttttcctttgttactcagtgagactaggcttgatctttgagtacccgctctcctgtggacaagtagttacatatgtccttatgacttatttttaaccaaaggccgagcaccaccttaggggctgccgtaagtaccatacagaacactggggtggggggcggggggcaccttcatttcactgtgtcatcgtctgtgttcagagcctctgcaaaggccttcatctgtcatgacattctgactttgaagttagtatgtgtatgattctgtcctcctaagtgctggcaattcttcatctaaactggactgaaatcctgttgtaaatgcctggtaatattagagggcctttctttgggtcttttgtagcttaattcctctatgttcaaaacaggaagttcttcagaaattatatcaatattttaattgatgctatgaaagacagtcccagtgaatgactgtccactttatttttgcctcttttatatccattttgattgacaacttttggctggatcatgcctttcagagagttttcttccagcctgcttggatgagtataataaccgactttgttatttttacggacctgggaacctttctagggggtggggtggggtggggtggggtggggagtcctggtagaggccacatctgtggcagctgtgaagaagggatgaagccagctgctcttgctaaggctgcttgtcattggtagaaggactcaccggtttgggttacttaaaaggctaaatatagagttggcaaacttctccaagcggggagggttttttttttgttccatgcatctaacgtgatttaaaagcatgacttcctataggttatgaaaactggtgtgctgcagatccagtgtggaagaggtgactgggcgttggggacagctttgatggtgacacttctagctctgagagtctcctactctgggtccactcttagcttggctcttaggaaaaactggtcagctaaaggcccaccactttctttctatagacttttgcctggttgaagtctgtggcttaaaaaaaatagttgaatctttcttgagaactctgtaacaaagtatgtttttgattaaaaagagaaagccaactaaa

SEQ ID NO: 158 - protein, 402 aa, Mus musculus
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSMLVKDEYVHDFEGQPSLPTEGHSIQTIQHPPSNRASTETYSAPALLAPAESNATSTTNFPNIPVASTRPVHNELAFQPPISNHPAPEYWCSIAYFEMDVQVGETFKVPSSCPVVTVDGYVDPSGGDRFCLGQLSNVHRTEAIERARLHIGKGVQLECKGEGDVWVRCLSDHAVFVQSYYLDREAGRAPGDAVHKIYPSAYIKVSVYMSLICGSVTGRCSNRRPLRKLQLLLRRRPWQGTSLALGPWVE

SEQ ID NO: 159 - DNA, 7326 bp, Mus musculus
agtgtccttccgacaagttggcagcaacaacacggccctggtcgtcgtcgccgctgcggtaacggagcggctcgggtggcggagcccgtgttcgcgtccgtccgcccgcccgcccgccgtcctccggaggcccttcccgcgccgcgctccgctccgcggccgtccccggggcgggagcgcgtgaccggagccggcgcccgcgagcgaggccccccgcagcggggcggctccggagctccagcggcccggccggccggcgcggtccgcggcgcggcggggagagggggccgcctgggccggacgccgcgggcggggcccgggaagcgacagcgaggcgaggcgcggtgcggcgcggagcccaggtcatcctgctcaccagatgtcttgacagtttttcttgcaacattggccattggttttcactgccttcaaaagatcaaaattactccagaaattggagagttggatttaaaagaaaaaacttgaacaaatggacaatatgtctataacaaatacaccaacaagtaacgatgcctgtctgagcattgtacatagtttgatgtgtcatagacaaggtggggaaagtgaaacctttgcaaaaagagcaattgagagtttggtaaagaagctgaaagagaaaaaagatgaattggattctttaataacagctataactacaaatggagctcatcctagcaagtgtgtcaccatacagagaacattggatggacgacttcaggtggctggtcggaaaggatttcctcatgtgatctatgcccgtctgtggaggtggcctgatctacacaagaatgaactaaagcatgttaaatattgtcagtatgcgtttgacttaaaatgtgacagtgtctgtgtgaatccatatcactatgagcgggttgtctcacctggaattgatctctcaggattaacactgcagagtaatgctccaagtatgttagtgaaggatgagtacgttcacgactttgaaggacagccgtccttacccactgaaggacattcgattcaaaccatccaacacccgccaagtaatcgcgcatcaacggagacgtacagcgccccggctctgttagccccggcagagtctaacgccaccagcaccaccaacttccccaacattcctgtggcttccacaactcctgagtactggtgctccattgcttactttgaaatggacgttcaggtaggagagacgtttaaggtcccttcaagctgccctgttgtgactgtggatggctatgtggatccttcgggaggagatcgcttttgcttgggtcaactctccaatgtccacaggacagaagcgattgagagagcgaggttgcacataggcaaaggagtgcagttggaatgtaaaggtgaaggtgacgtttgggtcaggtgccttagtgaccacgcggtctttgtacagagttactacctggacagagaagctggccgagcacctggcgacgctgttcataagatctacccaagcgcgtatataaaggtctttgatctgcggcagtgtcaccggcagatgcagcaacaggcggccactgcgcaagctgcagctgctgctcaggcggcggccgtggcagggaacatccctggccctgggtccgtgggtggaatagctccagccatcagtctgtctgctgctgctggcatcggtgtggatgacctccggcgattgtgcattctcaggatgagctttgtgaagggctggggcccagactaccccaggcagagcatcaaggaaaccccgtgctggattgagattcaccttcaccgagctctgcagctcttggatgaagtcctgcacaccatgcccattgcggacccacagcctttagactgagatctcacaccacggacgccctaaccatttccaggatggtggactatgaaatatactcgtgtttataatctgaagatctattgcattttgttctgctctgtcttttcctaaagggttgagagatgtgtttgctgccttgctcttagcagacagaaactgaattaaaacttcttttctattttagaactttcaggtgtggctcagtgcttgaagatcagaaagatgcagttcttgctgagtcttccctgctggttctgtatggaggagtcggccagtgctgggcgctcagccctttagtgtgtgcgagcgccttgcatgccgaggagagtcagagctgctgattgtaaggctgagaagttctcacagttaagccacctgccccttagtgggcgagttattaaacgcactgtgctcacgtggcgctgggccagccagctctaccaagagcaactttactctcctttaaaaaccttttagcaacctttgattcacaatggtttttgcaagttaaacagtgaaggtgaattaaattcatactgtcttgcagacttcagggtttcttccccaagacaaaacactaatctgtgtgcatattgacaattccttacaattatcagtcaaagaaatgccatttaaaattacaatttttttaatccctaatggatgaccactatcaagatgtatactttgccctgttaaacagtaaatgaattcttctatatttctaggcacaaggttagttatttaaaaaaaaaaaaaaaagcctaggggagggatttttcccttaattcctagggagaaggttttgtataaaacactaaaagcagtgtcactctgcctgctgcttcactgttctgcaaggtggcagtacttcaactgaaataatgaatattttggaaactgctaaattctatgttaaatactgtgcagaataatggaaacagtgcagttggtaacaggtggtttggatatttttgtacttgatttgatgtgtgacttcttttcatatactgttaaaatcatgtatgttttgacattgtttaaaattcagtttttgtatcttagggcaagactgcagacttttttataccttttggttataagccctgtgtttgccatccttgatcacttggcggtgactttgtagagattgaagtggaggagttaagacacattgactgtaccacagacacacatgtatactttctacctagttactagcgtaaataaaactgagtcactatacgaagtggaattctagatttggtttttaaaatgctttccttttgcacttttgagtccagtctcagtggcaagacaccttctgctaaatgacaggtggcagccagttgtaccatgcagcgctggttccctcccactctaccaggactttcccatggacactgtgcatcatgtgtagttggttattttttgagtttttattttactgtagcaaaaaaaaaaaaaaaaacttggataaatagtgtgaataaaatcaagaccatggagatgtttttaccctgagagttttctgtgagttttaaattgcagtaggcatttgagctctggaaaccccgtgcatagcagttctctttgtgccaacagaaatgaccacgtcctgcagcctgctgcggaaggttccagaggctctgagaaaccagagtgctgcagtgactggggtccatctcagcccagcgcacacagcgtgcgttgtaaaagctgcctctgtgtcttgtcttctgtacttagggatgctttgtctcgggcctaatcttatctgtagaagtttggtgattttttttttttaaatgttgtattgacagaattataaaaagataccttctctagaaatgcttgtcttcagatccgtttcacgatggccggggaacaggagtgagaagagagagtaagctgtagtgtaacgggtttttaagacccagctcatctgaccaggcagtgctgtaacttgatgcttcctgttgtaccttatggaacctttcccatatttaatcatcttcagaaagtaggtgggaaatatttgctgggaagtatctcttcagagccaagccacttgtcttggttttcttactaagagccatagaaatgatttctggttattgatgaaatttgtaatttgcctgtcctagtcttttttcctttcacttcgctatctttgaataagacttttaaaaacttccctgagttgaaaaattttgggataaaatagtttccctagttcttagagactgattatgatgtgggtatggttctgggtgggttttttttctaagtcatagctcaaaagtctcccaagattaaatttcagtgggcacccagtttgaaaccattctacttttgtcttgtgcctttctttgcatgattaaagagaatctgtaatggtattgcctttatttgcttggaagtagattcttttctgggatagagtctaccttaatcgttgtcctttaccgcccctgctgtacagatagatgctaagccactgccgggaacttgcttttccatagacagtctttttatactgcctgaacccattgctcctgttcacagtataagttcacagacagggtgagccggccgaggcgcacacctgcagaatccagcaacaaccatgcttaactgtgtgtatttcaaagttagaaatccagttttgtggggaatggtgtggtttatattagcagctttgaaggcgaagtaactcagaggttttacagtctggagaagggaagcttcctggaatgcttgtgaagtatctgtggtggccaaatgtgtttgctcctggccttgcttgtaactggctaattgtcactcttcagatttttaaaaatttttaatgagctgagacccccttggaaggagcttgtttggagctggccagagatgtttttggtagttcctgtcttcatccggtcttcatcactgttttctttaatggtcagttagtaaagtataagttaggtcactgtcatgagtggagcaggaacaactctcccaggtgggggcctggaagggactcgttacatggagccatctgtaactagccctttaaatcctcctttgcatgacatagagaaaaggctgtgagactcctgcccaggcctttctagttttcccttctagtaaccaagcaatcgcatctctgcggtgcagtaggctgtatgtaaaaagccgtggccttactcctagcagcacccttggcagggcctttttctcagcgcagtgaggctgtgcatctggcactcctgaggaatgaaagttttcatcatcttgccttattaagcagtaaaacttttgaaaaatgagccgtttattggcaggagctatttacacaaatcagaatattataccatttctttttctctctctcctgtctctgtggacctccggggcttctgagatagacagtactgcctagccattcgaaatgcccaagccagctggggttgttgggctctcctctcccttcctccttcctcacagctcctgctcttgcgtggttagtgagcctctactcagtgtttcctgtcctcgctgctcaggcgagggaagacgacaactgatagtcttagagttcacctttctgtcgggggcggcattgttctgattgctgccatcgtctccgatccttgatgagttttatacgattgatgtggagagaatttaattgatattcatagcccatagctgctcccctctccctggtgttgtggaagatttagtttccaccgaattcactcaaaaagctgtcctgttggcaccagcaaaccacacgctcttttagaaaacatctttgcttgttttgtgtcctgaccctgctctctggcctccttcctctgtagatacttctgacctataggtgcctttatgagaattgagggtctgataccgtgccccaaggaatagctgatgcaatgagtgatgtttttcagggattttagcatcaaattaaataaatgaatgaaacttttaagtccttcttttcttttatttttttaatgcaggaaggactgaggagacgtcgggtgacgacaatcatttctctgtgttgctgtaaaggctttcacacagtttaagatgcttttctcagtagctccagagttgatgttcttgttcaacctaaagcaggctctggactcgcccagaccgttgcacttgtagtttacgacttcatgtgtcctccctcggcaagtcattcccttctctgggcctcagctgcctcgtctgtgaaatgaggggttggactattgtgccagctctggcttctaagtgaccttgcccgccctgcagcaggttgagatgcgctctttaccttttttctgctgtgtgagggggaatcttactttttcctttgttactcagtgagactaggcttgatctttgagtacccgctctcctgtggacaagtagttacatatgtccttatgacttatttttaaccaaaggccgagcaccaccttaggggctgccgtaagtaccatacagaacactggggtggggggcggggggcaccttcatttcactgtgtcatcgtctgtgttcagagcctctgcaaaggccttcatctgtcatgacattctgactttgaagttagtatgtgtatgattctgtcctcctaagtgctggcaattcttcatctaaactggactgaaatcctgttgtaaatgcctggtaatattagagggcctttctttgggtcttttgtagcttaattcctctatgttcaaaacaggaagttcttcagaaattatatcaatattttaattgatgctatgaaagacagtcccagtgaatgactgtccactttatttttgcctcttttatatccattttgattgacaacttttggctggatcatgcctttcagagagttttcttccagcctgcttggatgagtataataaccgactttgttatttttacggacctgggaacctttctagggggtggggtggggtggggtggggtggggagtcctggtagaggccacatctgtggcagctgtgaagaagggatgaagccagctgctcttgctaaggctgcttgtcattggtagaaggactcaccggtttgggttacttaaaaggctaaatatagagttggcaaacttctccaagcggggagggttttttttttgttccatgcatctaacgtgatttaaaagcatgacttcctataggttatgaaaactggtgtgctgcagatccagtgtggaagaggtgactgggcgttggggacagctttgatggtgacacttctagctctgagagtctcctactctgggtccactcttagcttggctcttaggaaaaactggtcagctaaaggcccaccactttctttctatagacttttgcctggttgaagtctgtggcttaaaaaaaatagttgaatctttcttgagaactctgtaacaaagtatgtttttgattaaaaagagaaagccaactaaa

SEQ ID NO: 160 - protein, 455 aa, Mus musculus
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSMLVKDEYVHDFEGQPSLPTEGHSIQTIQHPPSNRASTETYSAPALLAPAESNATSTTNFPNIPVASTTPEYWCSIAYFEMDVQVGETFKVPSSCPVVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 161 - DNA, 7614 bp, Mus musculus
agtgtccttccgacaagttggcagcaacaacacggccctggtcgtcgtcgccgctgcggtaacggagcggctcgggtggcggagcccgtgttcgcgtccgtccgcccgcccgcccgccgtcctccggaggcccttcccgcgccgcgctccgctccgcggccgtccccggggcgggagcgcgtgaccggagccggcgcccgcgagcgaggccccccgcagcggggcggctccggagctccagcggcccggccggccggcgcggtccgcggcgcggcggggagagggggccgcctgggccggacgccgcgggcggggcccgggaagcgacagcgaggcgaggcgcggtgcggcgcggagcccaggtcatcctgctcaccagatgtcttgacagtttttcttgcaacattggccattggttttcactgccttcaaaagatcaaaattactccagaaattggagagttggatttaaaagaaaaaacttgaacaaatggacaatatgtctataacaaatacaccaacaagtaacgatgcctgtctgagcattgtacatagtttgatgtgtcatagacaaggtggggaaagtgaaacctttgcaaaaagagcaattgagagtttggtaaagaagctgaaagagaaaaaagatgaattggattctttaataacagctataactacaaatggagctcatcctagcaagtgtgtcaccatacagagaacattggatggacgacttcaggtggctggtcggaaaggatttcctcatgtgatctatgcccgtctgtggaggtggcctgatctacacaagaatgaactaaagcatgttaaatattgtcagtatgcgtttgacttaaaatgtgacagtgtctgtgtgaatccatatcactatgagcgggttgtctcacctggaattgatctctcaggattaacactgcagagtaatgctccaagtatgttagtgaaggatgagtacgttcacgactttgaaggacagccgtccttacccactgaaggacattcgattcaaaccatccaacacccgccaagtaatcgcgcatcaacggagacgtacagcgccccggctctgttagccccggcagagtctaacgccaccagcaccaccaacttccccaacattcctgtggcttccacaagtcagccggccagtattctggcgggcagccatagtgaaggactgttgcagatagcttcagggcctcagccaggacagcagcagaatggatttactgctcagccagctacttaccatcataacagcactaccacctggactggaagtaggactgcaccatacacacctaatttgcctcaccaccaaaacggccatcttcagcaccacccgcctatgccgccccatcctggacattactggccagttcacaatgagcttgcattccagcctcccatttccaatcatcctgctcctgagtactggtgctccattgcttactttgaaatggacgttcaggtaggagagacgtttaaggtcccttcaagctgccctgttgtgactgtggatggctatgtggatccttcgggaggagatcgcttttgcttgggtcaactctccaatgtccacaggacagaagcgattgagagagcgaggttgcacataggcaaaggagtgcagttggaatgtaaaggtgaaggtgacgtttgggtcaggtgccttagtgaccacgcggtctttgtacagagttactacctggacagagaagctggccgagcacctggcgacgctgttcataagatctacccaagcgcgtatataaaggtctttgatctgcggcagtgtcaccggcagatgcagcaacaggcggccactgcgcaagctgcagctgctgctcaggcggcggccgtggcagggaacatccctggccctgggtccgtgggtggaatagctccagccatcagtctgtctgctgctgctggcatcggtgtggatgacctccggcgattgtgcattctcaggatgagctttgtgaagggctggggcccagactaccccaggcagagcatcaaggaaaccccgtgctggattgagattcaccttcaccgagctctgcagctcttggatgaagtcctgcacaccatgcccattgcggacccacagcctttagactgagatctcacaccacggacgccctaaccatttccaggatggtggactatgaaatatactcgtgtttataatctgaagatctattgcattttgttctgctctgtcttttcctaaagggttgagagatgtgtttgctgccttgctcttagcagacagaaactgaattaaaacttcttttctattttagaactttcaggtgtggctcagtgcttgaagatcagaaagatgcagttcttgctgagtcttccctgctggttctgtatggaggagtcggccagtgctgggcgctcagccctttagtgtgtgcgagcgccttgcatgccgaggagagtcagagctgctgattgtaaggctgagaagttctcacagttaagccacctgccccttagtgggcgagttattaaacgcactgtgctcacgtggcgctgggccagccagctctaccaagagcaactttactctcctttaaaaaccttttagcaacctttgattcacaatggtttttgcaagttaaacagtgaaggtgaattaaattcatactgtcttgcagacttcagggtttcttccccaagacaaaacactaatctgtgtgcatattgacaattccttacaattatcagtcaaagaaatgccatttaaaattacaatttttttaatccctaatggatgaccactatcaagatgtatactttgccctgttaaacagtaaatgaattcttctatatttctaggcacaaggttagttatttaaaaaaaaaaaaaaaagcctaggggagggatttttcccttaattcctagggagaaggttttgtataaaacactaaaagcagtgtcactctgcctgctgcttcactgttctgcaaggtggcagtacttcaactgaaataatgaatattttggaaactgctaaattctatgttaaatactgtgcagaataatggaaacagtgcagttggtaacaggtggtttggatatttttgtacttgatttgatgtgtgacttcttttcatatactgttaaaatcatgtatgttttgacattgtttaaaattcagtttttgtatcttagggcaagactgcagacttttttataccttttggttataagccctgtgtttgccatccttgatcacttggcggtgactttgtagagattgaagtggaggagttaagacacattgactgtaccacagacacacatgtatactttctacctagttactagcgtaaataaaactgagtcactatacgaagtggaattctagatttggtttttaaaatgctttccttttgcacttttgagtccagtctcagtggcaagacaccttctgctaaatgacaggtggcagccagttgtaccatgcagcgctggttccctcccactctaccaggactttcccatggacactgtgcatcatgtgtagttggttattttttgagtttttattttactgtagcaaaaaaaaaaaaaaaaacttggataaatagtgtgaataaaatcaagaccatggagatgtttttaccctgagagttttctgtgagttttaaattgcagtaggcatttgagctctggaaaccccgtgcatagcagttctctttgtgccaacagaaatgaccacgtcctgcagcctgctgcggaaggttccagaggctctgagaaaccagagtgctgcagtgactggggtccatctcagcccagcgcacacagcgtgcgttgtaaaagctgcctctgtgtcttgtcttctgtacttagggatgctttgtctcgggcctaatcttatctgtagaagtttggtgattttttttttttaaatgttgtattgacagaattataaaaagataccttctctagaaatgcttgtcttcagatccgtttcacgatggccggggaacaggagtgagaagagagagtaagctgtagtgtaacgggtttttaagacccagctcatctgaccaggcagtgctgtaacttgatgcttcctgttgtaccttatggaacctttcccatatttaatcatcttcagaaagtaggtgggaaatatttgctgggaagtatctcttcagagccaagccacttgtcttggttttcttactaagagccatagaaatgatttctggttattgatgaaatttgtaatttgcctgtcctagtcttttttcctttcacttcgctatctttgaataagacttttaaaaacttccctgagttgaaaaattttgggataaaatagtttccctagttcttagagactgattatgatgtgggtatggttctgggtgggttttttttctaagtcatagctcaaaagtctcccaagattaaatttcagtgggcacccagtttgaaaccattctacttttgtcttgtgcctttctttgcatgattaaagagaatctgtaatggtattgcctttatttgcttggaagtagattcttttctgggatagagtctaccttaatcgttgtcctttaccgcccctgctgtacagatagatgctaagccactgccgggaacttgcttttccatagacagtctttttatactgcctgaacccattgctcctgttcacagtataagttcacagacagggtgagccggccgaggcgcacacctgcagaatccagcaacaaccatgcttaactgtgtgtatttcaaagttagaaatccagttttgtggggaatggtgtggtttatattagcagctttgaaggcgaagtaactcagaggttttacagtctggagaagggaagcttcctggaatgcttgtgaagtatctgtggtggccaaatgtgtttgctcctggccttgcttgtaactggctaattgtcactcttcagatttttaaaaatttttaatgagctgagacccccttggaaggagcttgtttggagctggccagagatgtttttggtagttcctgtcttcatccggtcttcatcactgttttctttaatggtcagttagtaaagtataagttaggtcactgtcatgagtggagcaggaacaactctcccaggtgggggcctggaagggactcgttacatggagccatctgtaactagccctttaaatcctcctttgcatgacatagagaaaaggctgtgagactcctgcccaggcctttctagttttcccttctagtaaccaagcaatcgcatctctgcggtgcagtaggctgtatgtaaaaagccgtggccttactcctagcagcacccttggcagggcctttttctcagcgcagtgaggctgtgcatctggcactcctgaggaatgaaagttttcatcatcttgccttattaagcagtaaaacttttgaaaaatgagccgtttattggcaggagctatttacacaaatcagaatattataccatttctttttctctctctcctgtctctgtggacctccggggcttctgagatagacagtactgcctagccattcgaaatgcccaagccagctggggttgttgggctctcctctcccttcctccttcctcacagctcctgctcttgcgtggttagtgagcctctactcagtgtttcctgtcctcgctgctcaggcgagggaagacgacaactgatagtcttagagttcacctttctgtcgggggcggcattgttctgattgctgccatcgtctccgatccttgatgagttttatacgattgatgtggagagaatttaattgatattcatagcccatagctgctcccctctccctggtgttgtggaagatttagtttccaccgaattcactcaaaaagctgtcctgttggcaccagcaaaccacacgctcttttagaaaacatctttgcttgttttgtgtcctgaccctgctctctggcctccttcctctgtagatacttctgacctataggtgcctttatgagaattgagggtctgataccgtgccccaaggaatagctgatgcaatgagtgatgtttttcagggattttagcatcaaattaaataaatgaatgaaacttttaagtccttcttttcttttatttttttaatgcaggaaggactgaggagacgtcgggtgacgacaatcatttctctgtgttgctgtaaaggctttcacacagtttaagatgcttttctcagtagctccagagttgatgttcttgttcaacctaaagcaggctctggactcgcccagaccgttgcacttgtagtttacgacttcatgtgtcctccctcggcaagtcattcccttctctgggcctcagctgcctcgtctgtgaaatgaggggttggactattgtgccagctctggcttctaagtgaccttgcccgccctgcagcaggttgagatgcgctctttaccttttttctgctgtgtgagggggaatcttactttttcctttgttactcagtgagactaggcttgatctttgagtacccgctctcctgtggacaagtagttacatatgtccttatgacttatttttaaccaaaggccgagcaccaccttaggggctgccgtaagtaccatacagaacactggggtggggggcggggggcaccttcatttcactgtgtcatcgtctgtgttcagagcctctgcaaaggccttcatctgtcatgacattctgactttgaagttagtatgtgtatgattctgtcctcctaagtgctggcaattcttcatctaaactggactgaaatcctgttgtaaatgcctggtaatattagagggcctttctttgggtcttttgtagcttaattcctctatgttcaaaacaggaagttcttcagaaattatatcaatattttaattgatgctatgaaagacagtcccagtgaatgactgtccactttatttttgcctcttttatatccattttgattgacaacttttggctggatcatgcctttcagagagttttcttccagcctgcttggatgagtataataaccgactttgttatttttacggacctgggaacctttctagggggtggggtggggtggggtggggtggggagtcctggtagaggccacatctgtggcagctgtgaagaagggatgaagccagctgctcttgctaaggctgcttgtcattggtagaaggactcaccggtttgggttacttaaaaggctaaatatagagttggcaaacttctccaagcggggagggttttttttttgttccatgcatctaacgtgatttaaaagcatgacttcctataggttatgaaaactggtgtgctgcagatccagtgtggaagaggtgactgggcgttggggacagctttgatggtgacacttctagctctgagagtctcctactctgggtccactcttagcttggctcttaggaaaaactggtcagctaaaggcccaccactttctttctatagacttttgcctggttgaagtctgtggcttaaaaaaaatagttgaatctttcttgagaactctgtaacaaagtatgtttttgattaaaaagagaaagccaactaaa

SEQ ID NO: 162 - protein, 551 aa, Mus musculus
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSMLVKDEYVHDFEGQPSLPTEGHSIQTIQHPPSNRASTETYSAPALLAPAESNATSTTNFPNIPVASTSQPASILAGSHSEGLLQIASGPQPGQQQNGFTAQPATYHHNSTTTWTGSRTAPYTPNLPHHQNGHLQHHPPMPPHPGHYWPVHNELAFQPPISNHPAPEYWCSIAYFEMDVQVGETFKVPSSCPVVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 163 - DNA, 7013 bp, Homo sapiens
atccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctg

SEQ ID NO: 164 - DNA, 7097 bp, Homo sapiens
atccgggtcctgggcgagcgggcgccgtgcgcgtgtcccgcggccgagctgctaataaagttgcagcgaggagaagcgcagcgacggcgtcgggagagcgcgcctagccggctcgcgaaaaggaagctgttgaagttattgaagtacctgttgctatattctaagaaattaaaatgtccagaaatctgcctctaaatgggatctcactatgttgctcagactggacgtgattgaactcctgggctcaagtgagtctcccgaataactgggattacaggacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctg

SEQ ID NO: 165 - DNA, 6939 bp, Homo sapiens
atccgggtcctgggcgagcgggcgccgtgcgcgtgtcccgcggccgagctgctaataaagttgcagcgaggagaagcgcagcgacggcgtcgggagagcgcgcctagccggctcgcgagacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaaatgacgtcaatggccagcttgttttcttttactagtccagcagtaaagcgattgttgggctggaaacaaggtgatgaggaggagaaatgggcagaaaaggcagttgatgctttggtgaagaaactaaaaaagaaaaagggtgccatggaggaactggagaaagccttgagcagtccaggacagccgagtaaatgtgtcactattcccagatctttagatggacgcctgcaggtttctcacagaaaaggcttaccccatgttatatattgtcgtgtttggcgctggccggatttgcagagtcatcatgagctaaagccgttggatatttgtgaatttccttttggatctaagcaaaaagaagtttgtatcaacccataccactataagagagtggagagtccagtcttacctccagtattagtgcctcgtcataatgaattcaatccacaacacagccttctggttcagtttaggaacctgagccacaatgaaccacacatgccacaaaatgccacgtttccagattctttccaccagcccaacaacactccttttcccttatctccaaacagcccttatcccccttctcctgctagcagcacatatcccaactccccagcaagttctggaccaggaagtccatttcagctcccagctgatacgcctcctcctgcctatatgccacctgatgatcagatgggtcaagataattcccagcctatggatacaagcaataatatgattcctcagattatgcccagtatatccagcagggatgttcagcctgttgcctatgaagagcctaaacattggtgttcaatagtctactatgaattaaacaatcgtgttggagaagcttttcatgcatcttctactagtgtgttagtagatggattcacagatccttcaaataacaaaagtagattctgcttgggtttgttgtcaaatgttaatcgtaattcgacaattgaaaacactaggcgacatattggaaaaggtgttcatctgtactatgttggtggagaggtgtatgcggaatgcctcagtgacagcagcatatttgtacagagtaggaactgcaactttcatcatggctttcatcccaccactgtctgtaagattcccagcagctgcagcctcaaaatttttaacaatcaggagtttgctcagcttctggctcaatctgtcaaccatgggtttgaggcagtatatgagctcaccaaaatgtgtaccattcggatgagttttgtcaagggttggggagcagaatatcaccggcaggatgtaaccagcaccccatgttggattgagattcatcttcatgggcctcttcagtggctggataaagtccttactcagatgggctcccctctgaaccccatatcttctgtttcataatgcagaagtattcttttcaattatattgttagtggacttgttttaattttagagaaactttgagtacagatactgtgagcttacattgaaaacagatattacagcttatttttttctacataattgtgaccaatacatttgtattttgtgatgaatctacatttgtttgtattcatgttcatgtgattaactcttagaagtgttgtaaaagatgcagagtaagtattatgccccagttcagaaatttggcattgatcttaaactggaacatgcttttactttattgccctaacaattttttattaaatttatttgaaaatgcatcacatgatgaaaaattatagtagcttataagagggcatatacagtgaagagtaagttttccctcctactctcgatcttccagaagctgtacttttaccagtttctttgtcccaccaacttaaaaaaaaaaagtacaattcattgttttgcaaaagtgtatggtaggggcttaaaagaaactataaagttttatttgaatgaacactatgcactgctgtaactggtagtgttcagtaaaagcaaaatgatagttttctagatgacataaaatttacatttaatacagataagtgttcttcagtgtaatgtgacttcatgctatatatcttttgtaagacatttccttttttaaaaaaatttttgcaaataactgatctcaagtatatgtcatttactcaaaatctgtcataagcattactttatagctagtgacagtgcatgcacagccttgttcaactatgtttgctgcttttggacaatgttgcaagaactctatttttgacatgcattaatcttttattttgcacttttatgggtgacagtttttagcataacctttgataaaatacactcaagtgacttggacttagatgcttatccttacgtccttggtaccttttttgtattaacaaacactgcaatttatagattacatttgtaggaagttatgcttttttctggtttttgttttactttcaacctaggttataagactgttattctatagctccaacttaaggtgcctttttaattccctacagttttatgggtgttatcagtgctggagaatcatgtagttaatcccattgctcttacaagtgtcagcttacttgtatcagcctccctacgcaaggacctatgcactggagccgtaggaggctcttcagttgggccccaaggataaggctactgatttgatactaaatgaatcagcagtggatgtagggatagctgattttaaaacactcggctgggcacagtggctcacacctgtaatcccagcactttgggaggctgaggcaggcagatcatgatgtcaggagtttgagaccagcctggccaatatggtgaaaccctgtctctacaaaaaatacaaaaattagctgggcatggtggtgcgtgcctgaagtcccagctactcgggaagctgaggcagaagaatcacttgaacctgggaggcggaggttgtggtgagccgagatcgcaccactgcactccagcctgggcgacagagcgagactctgcctcaaaaaacaaaacaaaacaaaacactcacccatcaacgaatatagactcttctctcatttatcgatgatcctctttttccattttttaagtacttatgtggaagctagtctcccaaaacacaatctttagagagaaaagacatgaacgaactccaaaatatccatttaatcaatcatgtttttggctttggataaagaactttgaaccagtttttttctcaggagctgtcaaatggacacttaattatgacatgagaatgaagaaattattttggaaaaaaaaaatgacctaatttacctatcagtgaaagctttattttctggtgccttttgaaagtatatggagtcatatcattcttctgtttaaaatgttagtttggtttgactttccactttgtcctttctgctcttgtgaagaaaaaaaaaagcattttcgaggaaagaattatgcaatttcttttgttttctgtgtcattatttattgctttttcaatgtgcagccagtggatggttttagttctttcagatgaactgccatttgtgtttcagctcacagttctttgctgggtaaaagaaatactttctgacagtcacctgagccttaaatgtaagtattacatgacatgcattctgtttcttccagagttctgtctgccacacgaaagagaatatttgcttacttgatagaactttggcattttcatcattcttttacttaaccaggcttatggcatgatctctggaacaaatttgtaggaaaaaattactccaattgaatgactgatgtatgtaatcaacttcattgggctgcagtaaactagtggaaattagagagttgttttattggtgttttctactgtgagttaattaaaaattgtttttatttggggtcattatgtcacagtcttgagttaacaagatcttacgtgattggccttttctttgttttctcttaggagttgtgtctcatgaatgacagtactaaagctattaacaactaagagtttgacagagaactataagcctgttgtatctcctaaaagttgtcaactccccacccttggactttaaatgaaaattttattcagtccagctattcttacagtccctaaggattttcatatatctatgtataggagataaaatttgctagtaagatttttaaaaactggctagtgaaaggaaagtacctctgaaagaaaccattttagcaaattatggttatatgttttaatttaatctacagaatgttttatagtaaaattctagcaccactagaataatcacatagcatgtacaatatatttatgctggctgaaaagacagaatctgggaataataaaattgcaaccagtttggtaatgcaaacagcagaatagaatgaaatctcagtaatgaattaaagcaacaaaaagatattgattggcaaaaagcaagatataagagattcatttgcttaacatttctacataatatttatggtctggtcagtattggtctggtcagtattgcctggctgacgtgaaatgtaaactagtaggcgtgttattgatctgctaaaactaaccctctttttaagaggagatttaaggaagacgtcaatcaaaatgtcaaatatgtgtgtcagaatataaataatttttcacattgtattgttgctatataaaaaaaataatagaattggttgggtttctgaggtgaaatccagagtaagagtactagacagttcaacaagccacatctaatggcacagatagaggatgtagctattttatacctttcataacatttgagagtaagatatccttcaggatgtgaagtgattattaagtactcatacctgaaatctgttgtcaagattagaactggggttcatgttaaaaaccttccatattacctgagggtacctgtggggaacagttccttcccctgtgtggtagtattttgttggaagagaatgtttatacaaaaaatgaaattcttccaacagcagagaaactctaaaaagtttgatagtacctatcaaagtgctgtacttctgtgatagagaacatctgatgtaccaatttagatctatttctttatactttttctaatcaattgcttaatagtactttggatgattatcacctttgccacttaaaatatataaatatcctttttacttcatgaggaaggaagaattttttgataattactgagttcagccttttgtgatgacttatattttggacttacattttaactttaaagaatgtcagatcccttctttgtcttactagttaaatcctcacctaatctcttgggtatgaatataaatgtgtgtcatcgttatattgttcagctagatgagcaagtatcttagggtagtaggtagcctggtggttttagaagtgtttggtgatttttatggagagagttttcctaagtggtggtttataggtggtatcagatattattagggcagctttttggggagtaatctcaggtctcccagagcagcagcatttttctcattgatataagtaagattcttaggagcttttcttatcacacaagatgcctgaatcgaatgtgagaattgaaggcatttcttctgcataaacaaagaattctacctgctggacagaaacctggaaagttctttggaattcgctgaattacagtttagtatgtcctgattacagagtgacaatatttatcaagcctttgttatattggattatcttctctcttaaaatacaactgtattataattgaaatgacagcccaaaattggatggtttaccaaaaccaatgaaagggatttcacacatcaatttttatttctgttttgaagagcacatgctatataataattgctagtagcaactgcagtaaaacaggtgataagttattttctctgaaaagatccagtcctagagcaggattcttcgatcattcatggcagagtgaaaaaggtttgtatggttcttgtccaaataactcagttcttaaaattcttaaaatgatcgtaaaccattatcctttaaaggtttatttgaagatgctgttaaagtacagaattttgtgtacaggtagatttttccgtccctcattaatagtgccttcttaattaatacagactggtgttagctataacaaaactccagtaaggccaaagaatcccaagttctttgtggaaaaaaaaaaaaaatcttttagggtcagattttcccttctaatatcattgaagatgatgttgcattgatttattcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgtgcttctgtttatgttgtagaagctgaaattctagcaacatgcttcaattctgttattttgatacttatgaaaatgtattaggttttactatattgtgcttttgaaagccataactcttaagaactttgtttttgcatattgtttgctaattctttactttaataaacctcaaaacctgc

SEQ ID NO: 166 - protein, 465 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEIHLHGPLQWLDKVLTQMGSPLNPISSVS

SEQ ID NO: 167 - DNA, 6585 bp, Mus musculus
atcatccgggtccccggcgagcgggcgccgagcgcttgtcccggggccgagctgctaataaagttgcggcgcgtgcacagcgcggcgacggcgtgaggagagcgcgcctgggcggcggggaggacttgcactaagaagaagcctatggcacctgtcaagttaaatgtcactccccgcctccacttggactttctgcttaagacctgcatgtgacttttcacctgcgagccacgcttttggtatctactgactttgattacaggaaagtgtctgaagatttgtatcaaatgacgtcaatggccagcttgttttctttcactagtccagccgtgaagcgattgttgggctggaaacaaggtgacgaggaagagaaatgggcagaaaaggcagtggatgctttagtgaaaaagctgaagaagaagaagggtgctatggaggagctggagaaagccttgagcagcccaggacagccaagcaagtgtgtcacgatccccaggtccttggatggacgtctgcaagtttctcacaggaaaggcttgccccatgttatatattgccgtgtttggcgctggccagatttgcagagccatcacgagctaaaaccattggatatttgtgaatttccttttggatctaagcaaaaggaagtttgtatcaatccataccactataagagagtggagagtccagtcttacctccagtattagtgcctcgtcacaatgaattcaatccacaacacagccttctggttcagttcaggaacctgagccacaatgaaccgcacatgccacaaaacgccacgtttcccgattctttccaccaacccaacaacgctcctttccccttatctcctaacagcccctatcctccttcccctgctagcagcacatatcccaactccccagcaagctctggacctggaagtccatttcaactcccagctgacacccctccccctgcctatatgccacctgatgatcagatggccccagataattcccagcctatggatacaagcagtaacatgattcctcagaccatgcccagcatatccagcagagatgttcagcctgtcgcctatgaggagcccaaacactggtgttcgattgtctactatgaattaaacaatcgtgttggggaagcttttcatgcatcttctactagtgtgttagtagatggatttacagatccttcaaataacaaaagtagattctgcctgggattgttgtcaaatgttaatcgtaattcaactattgaaaacactaggcggcatattggaaaaggtgttcatctatactacgttggtggggaggtgtacgctgagtgtcttagtgacagcagcatctttgttcagagtaggaactgcaactttcaccatggcttccatcccaccaccgtctgtaagatccccagcagctgcagcctcaagatttttaacaatcaggagtttgctcagcttctggctcagtcagtcaaccatggattcgaggctgtgtatgagctcaccaagatgtgtaccattcgaatgagctttgtcaagggctggggagcagagtaccaccgacaggacgtcaccagtactccctgctggattgagattcacctccacgggcctctgcagtggctggataaagtccttactcagatgggctctccgctgaaccccatttcttctgtttcatagtgcagaagtattctttcaactatatttttagtggacttgttttaattttagaggaatttccagtacagatgctgtgagctgacatggaaaacagatattattttttctacgtaattgtgaccaacacatttgtattttatgatgatattacatttgtttgtattcgtgttcattgtgattaactttcaaaagtattgtaaacgatgtagagtattttgcccctgttgaaatgtttagcattgatcttaaactggaacgtactttttcttattgtcccaacgttttttaatttgttaaattttttttacaaagtagttcatcacataatgaaattttatcctataagagaacatatattgtggaaagcagtagatgatatttctctgggaatttctttgccttaccacctttgaaaaagcatacattgtttgcaaaacctcaaagtagggcttgcttaaaggaaactgttgaatcttgtttgaaggacactgcagtcctaacgtgttcagtgaaagcaaggtggtagatttctggacgtcatacatttacatttaatataggtaatattcatcagtgtaatgtgacttcatgccatatatattttgtaaaacaattcctttttaaaaacttcaagtatttctcatttactcaaatttgttgtaagtcctacttaacagttagttactatgtgctctgtggccttgttcagcattgtttgctgctttgggccaacaattcaagaactctaattttcctgtgcattaatcttttcattttgcacttttatgggtgactgtcttagtgtagcctctggtaaaatactattaggtggcctggttttagagctcctcctcgctgccttggcactcctttgtgcaacacgaccacttagagatgacagctgtgagctgtgctgctttttctagcctttaatttccaatgtagtttataatgttgttcttctatagctccagctaaggtgcctgttagtcccctacaatgttatgagcattattgacattgaaaggttatgtatgtatgaatacctttgctccttaccagacttgtcatacaaggactcgtgcagtgtagccagtagaggctctttggttggcccaagaatgaggctgttggtgtaagtgaatcacaatagggattgggatagttcatgtcatatgtcatatagcaagacaatgtagagtgtaggcttgtctctctgcatcaacgctctgcctctttctttttatccttttagaacctacatggacgctaatctccacaacactgttggatgtgaacactcttaagacactcatctagttcactgtgccttgtccttaggactcttaaccactttctagggagcagttatggcctgagatggacagtcatggcctgagaatgaagacactactttgataaagaaaaaggcctcatttgcctatcagagtgagaaaggtttttttctggtgccttttgaaaatatacagagccacttggttcttctgctgaaaatgtaattttggtttgactttttagagtgcccttcctgcctttatgaggaaaacagctatttttttttttggggggggggattccttttgttttctgtgccattatttattgcctttcagagtgcaaccattgggtggctttgctccttcagagagggctccttgatagccttcagtagcttgagctgtagacataagtattccatagcaagagtgtgtcagctccatgagagagatgtctgctttatagccgaggcagaaaccgttcatgttcctttacttggcagccttcaggaacaggtttgtaagaacgtgtcttgagttgagtgagtgtatgtctgtgagctctgctgaagtctggacacaagggccttgcctgctccttttttcagcagtgggttacatgttgtctctccacagtcttcatgtcataggtctcggacttgcagagtcctatgtggcctgccatctgtacagtggcaggactgaagctctgagctgttctgaggttcatggagaaatcccaacctattctgtggtcagtaaatggagactgtgtagtctacctgctcctgtactgtccttactgtatgtaaggatatacagacgcctgtgggtaggcagtactcacagtgagatgaagacagcaagtgtgcactgaaccacagagggcagggagtagggcctctgaagaagccaccagaccagaccagtgccggtacagtctttgtcagagatggctctgatggggcccagactgaccctgaccatgctgagttgctgagggtagccttcagttctctaccctctgaagtgctaggatgacagacatccgccatcatacccagcttccgtggtgctaaggatcagcctcagtcttcaggcgtgctaggcatgtactttgccaagtatttagtatacaaaatacattagtatctgccagggaaaaaagatttgcaaataataaagattgccatcagtttgataaatgttgtaaatggaagaatcaaaatctcagcgatggattacagcaacaagatgctgcctaggaaaagcaggaccaagaggtacatttgactagtataccttcagcgtagcgtgatgacctcactgatgtcacccaactgaacttaagggctgtaagtaggcgtgctgtgggccttccagaactagagaaaattataggaggaagtcagttctaaagtatcaaaagctgggtaatggtggcacatgcctttgattctagcactcgggaagcaggggctagcctagtctacagagcaacttctacacagagaaactgtcttggaggaaaataaaaaaagaaaagtcaaagagcaaacaaatagaacagagtaggaatccgtgtccccttttttctatgtttcacggttgcaggtgtaagaaaagtagtcatagatgtggctgagtttctaagatgaaaccagtagtaagattgctaaatataacacttcaaccaagttaaacaccctttgggggtatgaatgaaagtaacactgcaatatgaaatgaaccgtgcaagtaacacttggggttacctcacagtctccctatgcctgagaggactgtgggaaacatttccatcccctgccagtatcgccattgggaggacagagtagatgaagaagtgaagtcttactggtccagggcacgcctgtcagcaatgccatttgtgcttctgccacagagagcaccgagaggcttggctcagtatcctcgaaccttctctggtcacttccctggcagcacttgggtccctgtcactcactggtctcttaaaagtcccgtctctttgcttcctaaagattctctaaaaaaattactattttttatttcttttttaaaagtctttgttattttgttttgggatacagtctctttgtacagtcctggctggcctggaaattactatgtaggccagcctcaaacttgaagtaattctcttgcctctgcctctggagttctgggattacaggcatgcactgcagagtacagtgagctctgatggcttttaaaattcagcccctttgagggtttggttttagatccattagctttgtctgaacccatctttgtccggccgagtaaatcctctgctatccggggtctcggtagaaatgtgttctcagtatacatacgactaaacattggttgtttataggtagcctcagatatttggtagagcatcttttttgaaagtaatctccagctaggtgggtatttccctcacagcagtaggattttccctttaggagataccagttcttcatctttcttgtgaaaataatgcctttatggggagtgaagattaaggagttgtttctacactaacagaattctatttgatggacaacttggacagttctgtggacttgggtgggttctagtgtgctaagaaggataacagtatttaatagtgtctgtcatcaggccttgctcatctccctgtctagggctgtaggtcagtgctcgagcacttagcaggcatcgagtctagtgttcagtgcccagcattgcacagaactcagaatatatctgtactgaaactgaagtgaccacctacaaccaggtggtatgccagaaccacagaaaggagattcacggtgatgtgtttaaagcattgggctggtgacggttgctgtgtagtaatgacctcttcctcagcaaagagagtcctggagcaggctgtcctcagaagagggaagggactggtgtgctccttgtgcagataacttagtgtataaatcggcatgagtagctatcctttaaggatttgtttgaagttactctttgtaaaaagttgagaattttgtgtgcagttgggcacatgcttgcccttcccccacccgccatagtcctgcctctcttgctgtgaactggtgtcagctacaacactccagctaggtctgagctcttttgagagaaggtctcgtagagcaccattctcagagagaagctaaagcatggggagccttaggacggtcaggcaatgcactctttaccacggctggctaaggctgcagcttgaccgtccttacctaaatcaggtaagaatgtgattacagagcgagtgcttgtgttccccggcctgccttctccgaggaagatgcttcatccgaggatgatgcagagcagacgatggctgcactgtaggtctgcctccttctgtgtatgggttctgctgctgcttacggcataggaaagtacactagcagcgtgcttcaattctgccatcttttgatacttataaaaatgtattaggttttactgtattgtgctctcaaagccataactcttaagaaatttggtttttttgcatattgtttgctaatactttgttttaataaacctcaaaatctgcttac

SEQ ID NO: 168 - DNA, 6988 bp, Mus musculus
ggggccgagctgctaataaagttgcggcgcgtgcacagcgcggcgacggcgtgaggagagcgcgcctgggcggcggggaggtgagtgaggggccccagggcgggcgctcggggcccggcggagggacaagcgccggcggcagcggcccgcgtgaggctggaggcctagaggctccccacgcgggacctgacggcacgggacggggctccgcgcagcgcgggaggccccggtgctaaggaggccccgcgcggccgacgaggccggcgcggacgaggccgctgccacctcggcgcgccaccgacgcccgggcccgcgcgcggagccgcgcaggcggcctaggccgagcgcgcgccccgccgctttgtgtctgggagataaggatccgcgcttatcggtgggaattacactccggccagccggctggcggcgacccgcccctgcgcccgcccgcccgcccgcccgcccgctcgcccgcccgtcactctccggacgtcgcagaggctccctcgctgcgctaaactttgtgacttgcactaagaagaagcctatggcacctgtcaagttaaatgtcactccccgcctccacttggactttctgcttaagacctgcatgtgacttttcacctgcgagccacgcttttggtatctactgactttgattacaggaaagtgtctgaagatttgtatcaaatgacgtcaatggccagcttgttttctttcactagtccagccgtgaagcgattgttgggctggaaacaaggtgacgaggaagagaaatgggcagaaaaggcagtggatgctttagtgaaaaagctgaagaagaagaagggtgctatggaggagctggagaaagccttgagcagcccaggacagccaagcaagtgtgtcacgatccccaggtccttggatggacgtctgcaagtttctcacaggaaaggcttgccccatgttatatattgccgtgtttggcgctggccagatttgcagagccatcacgagctaaaaccattggatatttgtgaatttccttttggatctaagcaaaaggaagtttgtatcaatccataccactataagagagtggagagtccagtcttacctccagtattagtgcctcgtcacaatgaattcaatccacaacacagccttctggttcagttcaggaacctgagccacaatgaaccgcacatgccacaaaacgccacgtttcccgattctttccaccaacccaacaacgctcctttccccttatctcctaacagcccctatcctccttcccctgctagcagcacatatcccaactccccagcaagctctggacctggaagtccatttcaactcccagctgacacccctccccctgcctatatgccacctgatgatcagatggccccagataattcccagcctatggatacaagcagtaacatgattcctcagaccatgcccagcatatccagcagagatgttcagcctgtcgcctatgaggagcccaaacactggtgttcgattgtctactatgaattaaacaatcgtgttggggaagcttttcatgcatcttctactagtgtgttagtagatggatttacagatccttcaaataacaaaagtagattctgcctgggattgttgtcaaatgttaatcgtaattcaactattgaaaacactaggcggcatattggaaaaggtgttcatctatactacgttggtggggaggtgtacgctgagtgtcttagtgacagcagcatctttgttcagagtaggaactgcaactttcaccatggcttccatcccaccaccgtctgtaagatccccagcagctgcagcctcaagatttttaacaatcaggagtttgctcagcttctggctcagtcagtcaaccatggattcgaggctgtgtatgagctcaccaagatgtgtaccattcgaatgagctttgtcaagggctggggagcagagtaccaccgacaggacgtcaccagtactccctgctggattgagattcacctccacgggcctctgcagtggctggataaagtccttactcagatgggctctccgctgaaccccatttcttctgtttcatagtgcagaagtattctttcaactatatttttagtggacttgttttaattttagaggaatttccagtacagatgctgtgagctgacatggaaaacagatattattttttctacgtaattgtgaccaacacatttgtattttatgatgatattacatttgtttgtattcgtgttcattgtgattaactttcaaaagtattgtaaacgatgtagagtattttgcccctgttgaaatgtttagcattgatcttaaactggaacgtactttttcttattgtcccaacgttttttaatttgttaaattttttttacaaagtagttcatcacataatgaaattttatcctataagagaacatatattgtggaaagcagtagatgatatttctctgggaatttctttgccttaccacctttgaaaaagcatacattgtttgcaaaacctcaaagtagggcttgcttaaaggaaactgttgaatcttgtttgaaggacactgcagtcctaacgtgttcagtgaaagcaaggtggtagatttctggacgtcatacatttacatttaatataggtaatattcatcagtgtaatgtgacttcatgccatatatattttgtaaaacaattcctttttaaaaacttcaagtatttctcatttactcaaatttgttgtaagtcctacttaacagttagttactatgtgctctgtggccttgttcagcattgtttgctgctttgggccaacaattcaagaactctaattttcctgtgcattaatcttttcattttgcacttttatgggtgactgtcttagtgtagcctctggtaaaatactattaggtggcctggttttagagctcctcctcgctgccttggcactcctttgtgcaacacgaccacttagagatgacagctgtgagctgtgctgctttttctagcctttaatttccaatgtagtttataatgttgttcttctatagctccagctaaggtgcctgttagtcccctacaatgttatgagcattattgacattgaaaggttatgtatgtatgaatacctttgctccttaccagacttgtcatacaaggactcgtgcagtgtagccagtagaggctctttggttggcccaagaatgaggctgttggtgtaagtgaatcacaatagggattgggatagttcatgtcatatgtcatatagcaagacaatgtagagtgtaggcttgtctctctgcatcaacgctctgcctctttctttttatccttttagaacctacatggacgctaatctccacaacactgttggatgtgaacactcttaagacactcatctagttcactgtgccttgtccttaggactcttaaccactttctagggagcagttatggcctgagatggacagtcatggcctgagaatgaagacactactttgataaagaaaaaggcctcatttgcctatcagagtgagaaaggtttttttctggtgccttttgaaaatatacagagccacttggttcttctgctgaaaatgtaattttggtttgactttttagagtgcccttcctgcctttatgaggaaaacagctatttttttttttggggggggggattccttttgttttctgtgccattatttattgcctttcagagtgcaaccattgggtggctttgctccttcagagagggctccttgatagccttcagtagcttgagctgtagacataagtattccatagcaagagtgtgtcagctccatgagagagatgtctgctttatagccgaggcagaaaccgttcatgttcctttacttggcagccttcaggaacaggtttgtaagaacgtgtcttgagttgagtgagtgtatgtctgtgagctctgctgaagtctggacacaagggccttgcctgctccttttttcagcagtgggttacatgttgtctctccacagtcttcatgtcataggtctcggacttgcagagtcctatgtggcctgccatctgtacagtggcaggactgaagctctgagctgttctgaggttcatggagaaatcccaacctattctgtggtcagtaaatggagactgtgtagtctacctgctcctgtactgtccttactgtatgtaaggatatacagacgcctgtgggtaggcagtactcacagtgagatgaagacagcaagtgtgcactgaaccacagagggcagggagtagggcctctgaagaagccaccagaccagaccagtgccggtacagtctttgtcagagatggctctgatggggcccagactgaccctgaccatgctgagttgctgagggtagccttcagttctctaccctctgaagtgctaggatgacagacatccgccatcatacccagcttccgtggtgctaaggatcagcctcagtcttcaggcgtgctaggcatgtactttgccaagtatttagtatacaaaatacattagtatctgccagggaaaaaagatttgcaaataataaagattgccatcagtttgataaatgttgtaaatggaagaatcaaaatctcagcgatggattacagcaacaagatgctgcctaggaaaagcaggaccaagaggtacatttgactagtataccttcagcgtagcgtgatgacctcactgatgtcacccaactgaacttaagggctgtaagtaggcgtgctgtgggccttccagaactagagaaaattataggaggaagtcagttctaaagtatcaaaagctgggtaatggtggcacatgcctttgattctagcactcgggaagcaggggctagcctagtctacagagcaacttctacacagagaaactgtcttggaggaaaataaaaaaagaaaagtcaaagagcaaacaaatagaacagagtaggaatccgtgtccccttttttctatgtttcacggttgcaggtgtaagaaaagtagtcatagatgtggctgagtttctaagatgaaaccagtagtaagattgctaaatataacacttcaaccaagttaaacaccctttgggggtatgaatgaaagtaacactgcaatatgaaatgaaccgtgcaagtaacacttggggttacctcacagtctccctatgcctgagaggactgtgggaaacatttccatcccctgccagtatcgccattgggaggacagagtagatgaagaagtgaagtcttactggtccagggcacgcctgtcagcaatgccatttgtgcttctgccacagagagcaccgagaggcttggctcagtatcctcgaaccttctctggtcacttccctggcagcacttgggtccctgtcactcactggtctcttaaaagtcccgtctctttgcttcctaaagattctctaaaaaaattactattttttatttcttttttaaaagtctttgttattttgttttgggatacagtctctttgtacagtcctggctggcctggaaattactatgtaggccagcctcaaacttgaagtaattctcttgcctctgcctctggagttctgggattacaggcatgcactgcagagtacagtgagctctgatggcttttaaaattcagcccctttgagggtttggttttagatccattagctttgtctgaacccatctttgtccggccgagtaaatcctctgctatccggggtctcggtagaaatgtgttctcagtatacatacgactaaacattggttgtttataggtagcctcagatatttggtagagcatcttttttgaaagtaatctccagctaggtgggtatttccctcacagcagtaggattttccctttaggagataccagttcttcatctttcttgtgaaaataatgcctttatggggagtgaagattaaggagttgtttctacactaacagaattctatttgatggacaacttggacagttctgtggacttgggtgggttctagtgtgctaagaaggataacagtatttaatagtgtctgtcatcaggccttgctcatctccctgtctagggctgtaggtcagtgctcgagcacttagcaggcatcgagtctagtgttcagtgcccagcattgcacagaactcagaatatatctgtactgaaactgaagtgaccacctacaaccaggtggtatgccagaaccacagaaaggagattcacggtgatgtgtttaaagcattgggctggtgacggttgctgtgtagtaatgacctcttcctcagcaaagagagtcctggagcaggctgtcctcagaagagggaagggactggtgtgctccttgtgcagataacttagtgtataaatcggcatgagtagctatcctttaaggatttgtttgaagttactctttgtaaaaagttgagaattttgtgtgcagttgggcacatgcttgcccttcccccacccgccatagtcctgcctctcttgctgtgaactggtgtcagctacaacactccagctaggtctgagctcttttgagagaaggtctcgtagagcaccattctcagagagaagctaaagcatggggagccttaggacggtcaggcaatgcactctttaccacggctggctaaggctgcagcttgaccgtccttacctaaatcaggtaagaatgtgattacagagcgagtgcttgtgttccccggcctgccttctccgaggaagatgcttcatccgaggatgatgcagagcagacgatggctgcactgtaggtctgcctccttctgtgtatgggttctgctgctgcttacggcataggaaagtacactagcagcgtgcttcaattctgccatcttttgatacttataaaaatgtattaggttttactgtattgtgctctcaaagccataactcttaagaaatttggtttttttgcatattgtttgctaatactttgttttaataaacctcaaaatctgcttac

SEQ ID NO: 169 - DNA, 6608 bp, Mus musculus
gccctttctcctctgcgcttctggctgcgccgagccgggaaccctaagctctgggaacttccccggtggcggccgtcttagggtcagagcatgctcagtggcccggacttttcggttgcagaaggagctggcggggatggtcgaggacttgcactaagaagaagcctatggcacctgtcaagttaaatgtcactccccgcctccacttggactttctgcttaagacctgcatgtgacttttcacctgcgagccacgcttttggtatctactgactttgattacaggaaagtgtctgaagatttgtatcaaatgacgtcaatggccagcttgttttctttcactagtccagccgtgaagcgattgttgggctggaaacaaggtgacgaggaagagaaatgggcagaaaaggcagtggatgctttagtgaaaaagctgaagaagaagaagggtgctatggaggagctggagaaagccttgagcagcccaggacagccaagcaagtgtgtcacgatccccaggtccttggatggacgtctgcaagtttctcacaggaaaggcttgccccatgttatatattgccgtgtttggcgctggccagatttgcagagccatcacgagctaaaaccattggatatttgtgaatttccttttggatctaagcaaaaggaagtttgtatcaatccataccactataagagagtggagagtccagtcttacctccagtattagtgcctcgtcacaatgaattcaatccacaacacagccttctggttcagttcaggaacctgagccacaatgaaccgcacatgccacaaaacgccacgtttcccgattctttccaccaacccaacaacgctcctttccccttatctcctaacagcccctatcctccttcccctgctagcagcacatatcccaactccccagcaagctctggacctggaagtccatttcaactcccagctgacacccctccccctgcctatatgccacctgatgatcagatggccccagataattcccagcctatggatacaagcagtaacatgattcctcagaccatgcccagcatatccagcagagatgttcagcctgtcgcctatgaggagcccaaacactggtgttcgattgtctactatgaattaaacaatcgtgttggggaagcttttcatgcatcttctactagtgtgttagtagatggatttacagatccttcaaataacaaaagtagattctgcctgggattgttgtcaaatgttaatcgtaattcaactattgaaaacactaggcggcatattggaaaaggtgttcatctatactacgttggtggggaggtgtacgctgagtgtcttagtgacagcagcatctttgttcagagtaggaactgcaactttcaccatggcttccatcccaccaccgtctgtaagatccccagcagctgcagcctcaagatttttaacaatcaggagtttgctcagcttctggctcagtcagtcaaccatggattcgaggctgtgtatgagctcaccaagatgtgtaccattcgaatgagctttgtcaagggctggggagcagagtaccaccgacaggacgtcaccagtactccctgctggattgagattcacctccacgggcctctgcagtggctggataaagtccttactcagatgggctctccgctgaaccccatttcttctgtttcatagtgcagaagtattctttcaactatatttttagtggacttgttttaattttagaggaatttccagtacagatgctgtgagctgacatggaaaacagatattattttttctacgtaattgtgaccaacacatttgtattttatgatgatattacatttgtttgtattcgtgttcattgtgattaactttcaaaagtattgtaaacgatgtagagtattttgcccctgttgaaatgtttagcattgatcttaaactggaacgtactttttcttattgtcccaacgttttttaatttgttaaattttttttacaaagtagttcatcacataatgaaattttatcctataagagaacatatattgtggaaagcagtagatgatatttctctgggaatttctttgccttaccacctttgaaaaagcatacattgtttgcaaaacctcaaagtagggcttgcttaaaggaaactgttgaatcttgtttgaaggacactgcagtcctaacgtgttcagtgaaagcaaggtggtagatttctggacgtcatacatttacatttaatataggtaatattcatcagtgtaatgtgacttcatgccatatatattttgtaaaacaattcctttttaaaaacttcaagtatttctcatttactcaaatttgttgtaagtcctacttaacagttagttactatgtgctctgtggccttgttcagcattgtttgctgctttgggccaacaattcaagaactctaattttcctgtgcattaatcttttcattttgcacttttatgggtgactgtcttagtgtagcctctggtaaaatactattaggtggcctggttttagagctcctcctcgctgccttggcactcctttgtgcaacacgaccacttagagatgacagctgtgagctgtgctgctttttctagcctttaatttccaatgtagtttataatgttgttcttctatagctccagctaaggtgcctgttagtcccctacaatgttatgagcattattgacattgaaaggttatgtatgtatgaatacctttgctccttaccagacttgtcatacaaggactcgtgcagtgtagccagtagaggctctttggttggcccaagaatgaggctgttggtgtaagtgaatcacaatagggattgggatagttcatgtcatatgtcatatagcaagacaatgtagagtgtaggcttgtctctctgcatcaacgctctgcctctttctttttatccttttagaacctacatggacgctaatctccacaacactgttggatgtgaacactcttaagacactcatctagttcactgtgccttgtccttaggactcttaaccactttctagggagcagttatggcctgagatggacagtcatggcctgagaatgaagacactactttgataaagaaaaaggcctcatttgcctatcagagtgagaaaggtttttttctggtgccttttgaaaatatacagagccacttggttcttctgctgaaaatgtaattttggtttgactttttagagtgcccttcctgcctttatgaggaaaacagctatttttttttttggggggggggattccttttgttttctgtgccattatttattgcctttcagagtgcaaccattgggtggctttgctccttcagagagggctccttgatagccttcagtagcttgagctgtagacataagtattccatagcaagagtgtgtcagctccatgagagagatgtctgctttatagccgaggcagaaaccgttcatgttcctttacttggcagccttcaggaacaggtttgtaagaacgtgtcttgagttgagtgagtgtatgtctgtgagctctgctgaagtctggacacaagggccttgcctgctccttttttcagcagtgggttacatgttgtctctccacagtcttcatgtcataggtctcggacttgcagagtcctatgtggcctgccatctgtacagtggcaggactgaagctctgagctgttctgaggttcatggagaaatcccaacctattctgtggtcagtaaatggagactgtgtagtctacctgctcctgtactgtccttactgtatgtaaggatatacagacgcctgtgggtaggcagtactcacagtgagatgaagacagcaagtgtgcactgaaccacagagggcagggagtagggcctctgaagaagccaccagaccagaccagtgccggtacagtctttgtcagagatggctctgatggggcccagactgaccctgaccatgctgagttgctgagggtagccttcagttctctaccctctgaagtgctaggatgacagacatccgccatcatacccagcttccgtggtgctaaggatcagcctcagtcttcaggcgtgctaggcatgtactttgccaagtatttagtatacaaaatacattagtatctgccagggaaaaaagatttgcaaataataaagattgccatcagtttgataaatgttgtaaatggaagaatcaaaatctcagcgatggattacagcaacaagatgctgcctaggaaaagcaggaccaagaggtacatttgactagtataccttcagcgtagcgtgatgacctcactgatgtcacccaactgaacttaagggctgtaagtaggcgtgctgtgggccttccagaactagagaaaattataggaggaagtcagttctaaagtatcaaaagctgggtaatggtggcacatgcctttgattctagcactcgggaagcaggggctagcctagtctacagagcaacttctacacagagaaactgtcttggaggaaaataaaaaaagaaaagtcaaagagcaaacaaatagaacagagtaggaatccgtgtccccttttttctatgtttcacggttgcaggtgtaagaaaagtagtcatagatgtggctgagtttctaagatgaaaccagtagtaagattgctaaatataacacttcaaccaagttaaacaccctttgggggtatgaatgaaagtaacactgcaatatgaaatgaaccgtgcaagtaacacttggggttacctcacagtctccctatgcctgagaggactgtgggaaacatttccatcccctgccagtatcgccattgggaggacagagtagatgaagaagtgaagtcttactggtccagggcacgcctgtcagcaatgccatttgtgcttctgccacagagagcaccgagaggcttggctcagtatcctcgaaccttctctggtcacttccctggcagcacttgggtccctgtcactcactggtctcttaaaagtcccgtctctttgcttcctaaagattctctaaaaaaattactattttttatttcttttttaaaagtctttgttattttgttttgggatacagtctctttgtacagtcctggctggcctggaaattactatgtaggccagcctcaaacttgaagtaattctcttgcctctgcctctggagttctgggattacaggcatgcactgcagagtacagtgagctctgatggcttttaaaattcagcccctttgagggtttggttttagatccattagctttgtctgaacccatctttgtccggccgagtaaatcctctgctatccggggtctcggtagaaatgtgttctcagtatacatacgactaaacattggttgtttataggtagcctcagatatttggtagagcatcttttttgaaagtaatctccagctaggtgggtatttccctcacagcagtaggattttccctttaggagataccagttcttcatctttcttgtgaaaataatgcctttatggggagtgaagattaaggagttgtttctacactaacagaattctatttgatggacaacttggacagttctgtggacttgggtgggttctagtgtgctaagaaggataacagtatttaatagtgtctgtcatcaggccttgctcatctccctgtctagggctgtaggtcagtgctcgagcacttagcaggcatcgagtctagtgttcagtgcccagcattgcacagaactcagaatatatctgtactgaaactgaagtgaccacctacaaccaggtggtatgccagaaccacagaaaggagattcacggtgatgtgtttaaagcattgggctggtgacggttgctgtgtagtaatgacctcttcctcagcaaagagagtcctggagcaggctgtcctcagaagagggaagggactggtgtgctccttgtgcagataacttagtgtataaatcggcatgagtagctatcctttaaggatttgtttgaagttactctttgtaaaaagttgagaattttgtgtgcagttgggcacatgcttgcccttcccccacccgccatagtcctgcctctcttgctgtgaactggtgtcagctacaacactccagctaggtctgagctcttttgagagaaggtctcgtagagcaccattctcagagagaagctaaagcatggggagccttaggacggtcaggcaatgcactctttaccacggctggctaaggctgcagcttgaccgtccttacctaaatcaggtaagaatgtgattacagagcgagtgcttgtgttccccggcctgccttctccgaggaagatgcttcatccgaggatgatgcagagcagacgatggctgcactgtaggtctgcctccttctgtgtatgggttctgctgctgcttacggcataggaaagtacactagcagcgtgcttcaattctgccatcttttgatacttataaaaatgtattaggttttactgtattgtgctctcaaagccataactcttaagaaatttggtttttttgcatattgtttgctaatactttgttttaataaacctcaaaatctgcttac

SEQ ID NO: 170 - protein, 465 aa, Mus musculus
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNAPFPLSPNSPYPPSPASSTYPNSPASSGPGSPFQLPADTPPPAYMPPDDQMAPDNSQPMDTSSNMIPQTMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEIHLHGPLQWLDKVLTQMGSPLNPISSVS

SEQ ID NO: 171 - DNA, 5592 bp, Homo sapiens
cgcactaatacgggcgatgaggcttcgcggctccagtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagttgacacaccacccctgccttatcatgccacagaagcctctgagacccagagtggccaacctgtagatgccacagctgatagacatgtagtgctatcgataccaaatggagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 172 - protein, 467 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSVDTPPLPYHATEASETQSGQPVDATADRHVVLSIPNGDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 173 - DNA, 5447 bp, Homo sapiens
agtctgactgacgccggctggggccgccgccgccgccgccgccgccgccgctgctgcagccgctgtctcggtccccgccgccgccgccgggccctgcaggcgctgggcgcgcgcagccaggcaagttggccaccctgttcaagggcttaggagaaagtcaacacacttcgcaacttgaattggtcccagctgctcccagaagaacgggcgggttggtccctatgccacccctggagagctactcgccgcccactttgccgtgaagggctgtgcggttcccgtgcgcgccggagcctgctgtggcctcttatgcactccaccacccccatcagctccctcttctccttcaccagccccgcagtgaagagactgctaggctggaagcaaggagatgaagaggaaaagtgggcagagaaggcagtggactctctagtgaagaagttaaagaagaagaagggagccatggacgagctggagagggctctcagctgcccggggcagcccagcaaatgcgtcacgattccccgctccctggacgggcggctgcaggtgtcccaccgcaagggcctgccccatgtgatttactgtcgcgtgtggcgctggccggatctgcagtcccaccacgagctgaagccgctggagtgctgtgagttcccatttggctccaagcagaaagaagtgtgcattaacccttaccactaccgccgggtggagactccagtactgcctcctgtgctcgtgccaagacacagtgaatataacccccagctcagcctcctggccaagttccgcagcgcctccctgcacagtgagccactcatgccacacaacgccacctatcctgactctttccagcagcctccgtgctctgcactccctccctcacccagccacgcgttctcccagtccccgtgcacggccagctaccctcactccccaggaagtccttctgagccagagagtccctatcaacactcagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaagggttggggtgctgagtatcatcgccaggatgtcaccagcaccccctgctggattgagattcatcttcatgggccactgcagtggctggacaaagttctgactcagatgggctctccacataaccccatttcttcagtgtcttaacagtcatgtcttaagctgcatttccataggatagaggctattgcagggagtggcttgtatcatttcagatttgcaactgaagtttctaaaaacatgtgtaaatacatagaatgtatactgttcttattttttttaatcaccgtttgttttgtgctttctagttaacctgatgccagtacagtgcaattggaaaagcaggactttggtgcctgtgctataagcagcagattttgtgggaggaaacacttgagaggcgatattgtcaacagtatttgaagggtgttagcagaataaaagacagctttagtcagccgtgtcattataaagcatgttgtgtggcctcacagaaacattgaaactgtttatacagcaaaagtcaggtattagcagcactaaagcaaatatcactcagatgaaacaaagcagtgaaacccctacagtttaaatgatgtcacttttagtgctgttggcaagaaaaaaaaaacaacaaacttgtacaatgaattaatgagataggccatagaaactttatttctaaggttgacatacctatagctgggctcctgtgctcatattcagtggtacattttaaacaaactgtgatcggaaaagaaaaaaaactgtgaagccaaaagtcatgttccctcagtctaccactgtaaaaacagagtctaatatgggaaaataaatatgaaaatagcatgaaatgctgtttcccagattgcaagataagaccagaacttggtccaagagccagccacccagggagactcctgctttccacagaggagaccaggttcctgtcgtgctggttgttcgtgtcaggcagtcctgcaaactttgagtctgcgcagcgtgccagaatagcttgtgtttcagtcctgtgtcaagaagcaggtgaaaccaaaggttggagaaaagcatcacacgtcgacttacactttctcatttcccacgttccagtctcctgggaagggcactctttcgccacgttttcctgcctcttggcaaatattaactctttgcagatcactaaagcaacagtaaagactttgagaaaatctagacacattattggatcaatgagttatttaacctagtgtctagtgattatctaacctggaaataaattcccaaggaaagtgataataatttcataatcatctgcaatttctggggaacagtggtactgaataataagacatcttttaaaaatatacacaatattaaaaacctgttcttattttactttagatgagggaggaaaatcccccaaatttctaggtactttcatatatatacttgccatgcactaaacactgcattgcttggaaaaatatttcacaccctctttaaaaatgtacaatttaagatggcagttatgcttgtaacagacagcacttcagtaatccaagaagtttcttcatttatacattttatctcaactctttctagcattagtgcacatggtagtttttctaattaaattgtattcaaggtagaaatgatcatgtgagaaagatatatgattgagctactactgtcacctcttacagttactagtgttagctaatagaaactttcatatatacacatagaaaagaattattacattttacattgaaaaatgtaatatatggcccatgtagtgtatagaaaaatctgtagtttattggttcatcaactatgtattgtgcacctacctatgggtgtcaggtacaatgttaggtactgtagaatcaaatgtaaataagagacagtcccagccctcagggagccgagaacctaatagtgaatctgtttgtacagacatcttcatgtttcagaacttttaaaacaaaacaaaataatgtaatctatcatcttttgcttgaaagaatgtgattgatttcttatctctgttttgaaattatttccttactcttctgcaaagtcaggtaatggattccttgtataaatgctacttttcttccatgtctcaaagttgttttttttcctcccctttcttccctgttttccaataattctccatgtccccttttcttagaaaaggcattaatatggtgaatcttgtatgggaaccattccatgggagaacttcaacacagtttttgctccagagatcaaacatagctttcgtgatctctctaccagctatctaacttatcctctggtaatctttttttttttttttttttttttgagatggagtctcgctgtgtcaccaggccagagtgcagtggcgtgatcttggctcactgcaacctctgcctcccgggttcgagtgattctcctgcctcagcctcccaagtagttgggactacaggctaccacgcccagctaatttttatatttttagtagagacggggtttcaccatggtagccagaatggtctctatctcttgaccttgtgatccgcccgcctcagcctcccaaagtgctgggattacaggcgtgagccactgcgcccggcttcctctggtaatcttacacctttacagaattaatctaaactggtggctcataaatgacattaaaaacaaaaaaaaaatctggatgcagtggctcattcctatagtcccagcactttgggaggccaaggcgggaggatcatctgagcccaggagtttggggctgtagtgaactatgatcatacaacttcattctagcctgggtgacaaagtgacaccctgtctctaaacaaaaatcaagaaacaaaaaacttgtatttccctgcagctttgggaagccagaacacaatattgcagtgaatctgaattttctgtgacaaataaattattaaattggcacatatgatcatcaccagtcatgtctcatcaaaagcctttattatgatgcttgtacattttgaagaatttagaattaatgagaagttaaccctttagtcattgtaacacaatcatattttaatcagctttttcttttgctaccaagagtttcaaaaaataaatgcagtatttgatttcaggctgctaaatgggctcatttagcattcattccttgatgtagacattaaaaaaaaaactgaatagcattctttccaggataactaataaagcagacatgctaagcctataaatacatcagcactgcagcacacgtttaaggttgccacggacaaggatcacacaatagagaacactgtagtaacatttcggtctgctcacaagacccagaacattgatcagtttttgttgttggtttattatttttctgttaaaaaattgtgaaaagtttgttttagctagatgatattttaatagctgcgagtgctttggaactataaagatgtcactacttaacacatataccttatgttttgttttgttttgttttacactcagtataaatcaggagaagttagccaaccatctagcatttagaatcctcttttttattgtcttctaaggatatggatgttcccataacagcaacaaaacagcaacaaaaacatttcataaatatcacttgatagactgtaagcacctgcttaactttgtgtcccaaatatttagtgtgtatatatatatatatatatacacacacacacacatatatattcaacaaataaagcaaaatataacatgcatttcacattttgtctttccctgttacgattttaatagcagaactgtatgacaagtttaggtgatcctagcatatgttaaattcaaattaatgtaaaacagattaacaacaacaaagaaactgtctatttgagtgaagtcatgctttctattataataacttggcttcggttatccatcaaatgcacacttatactgttatctgattgtttataataaagaatactgtacttata

SEQ ID NO: 174 - protein, 430 aa, Homo sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 175 - DNA, 5380 bp, Mus musculus
agcctgactgacgcctctggagccgctgtctcggtcccgccgccgcccggccgaccctgcagctaccgcgcaaccggagtgcgcggggggcacgcgtggcacctctcggacagagtaagctggctccactttccaagagctttggaagacgtcagcccatctcccagtttgaatcggaccccactgcttccagaaggaaaggcaagcttgttcctatgacatccgtggacaggtacttgccgccgacctgcccggggccctgcaagccttgaaaggtctcatcctctttccccgtgcagcagcctgagctctgcctcctatgcaccccagcacccccatcagctccctcttctccttcaccagccccgcagtgaagcggctgctgggctggaagcagggagatgaagaggagaagtgggcagagaaggcggtggactctttggtgaagaagttaaagaagaagaaaggcgccatggatgaactggagagggcgctgagctgcccgggtcagcctagcaagtgtgtcaccatcccacggtccctcgatggacgcctccaggtgtcccaccgaaaggggctgccccacgtcatctactgccgcgtgtggcgctggccagacctgcagtcccatcatgagctgaagcccttggagtgctgtgagttcccgttcggctccaagcagaaggaggtctgcatcaacccataccattaccgcagagtggagaccccagttctgcctccagtgctggtaccaagacacagcgagtacaaccctcagctcagcctcctggccaagttccgaagtgcctcgctgcacagcgaacccctcatgccgcacaacgccacctaccctgactctttccagcagtctctctgtccggcaccgccctcctcgccaggccatgtgtttccgcagtctccatgccccaccagctacccgcactcccccggaagtccttccgagtcagacagtccctatcaacactcagacttccggccagtttgctacgaggaaccccagcactggtgttctgttgcctactacgaactaaacaaccgggtcggagagactttccaggcgtcctcgcggagcgtgctcatagacggcttcaccgacccttccaataacaggaataggttctgccttgggcttctctcaaatgtaaacagaaactcgaccatagaaaacaccaggaggcacattggaaagggtgtgcatttgtactacgttgggggcgaggtgtatgcggagtgcgtgagcgacagcagcatctttgtccagagccggaactgcaactaccagcacggcttccacccggccaccgtctgcaagatccccagcggctgcagcctcaaggtcttcaacaaccagctcttcgcccagctgctcgcccagtccgtgcaccacggctttgaagtggtgtatgagctgacgaagatgtgcacgattcggatgagctttgtgaagggctggggagcagagtatcatcgccaggatgtcacgagcaccccctgctggatcgagatccatcttcatggaccgctgcagtggttggataaggtgctcactcagatgggctccccacacaaccctatctcttcagtgtcttaagtcacgtcgtcagccacgttgccacagaacagactcgggcaggggcttccatcgtggcaaccgcagctaatgcagggttccggatgcagatgtaaatacacgtgtaacgcatccgagtcacgtttatatcaccgtttgttttgtgctacctacttaacctggggccagtgcggtgtggtcgaagaagcgtggtttctctctgatgggagccaagtcttctgtgagagggaaacagcacgtgagggcgtcggcaggactcaaggccaccgagtcagctcatcgtcactccacaggaggttgtgccccacatggaaaacacaaagctgcttacacagaaggaataggagcactagagcaaaatcagtcacacacaagtggttttaaaaagacctcacttgcaatgtgagtgtcaagaaagaaaaccaagcttgtccagggacctgtgagataaagccacagaaactttatctccgaagctgaaatacacatagccaggtactgtgctgacggcaggtacattcaaccagatctaaactgtgattggagagggagaaactgtgaagcttggagtcagtggcctcaatctaaaacaagcaagcaggcaggcaggcaggcgggcgggcgggcgggcaggcgggtgggcaggcaggcaagcaaagccaaggctcttaagggaaaccggcctgagaggaggcttgatccagggttagcccagaattcaggcccggaagcacagggaactcctgcgtccactctggaagccatcttcccgtcttcccgtccctcctgtctgaccttgcagatggctgcctgccctgtgcacactacaaaccccgtgcagagatgaagctgtagactggaaggttgggagggaagtgcaggctaggcagggcatcccttgcctcatttttcctcctggtgacaaatagcaattagtgacagatgattcaaacaagagcaaagccttgggaaagctcgaggcatctttggatcttatttatgcatctctcagcctggcacctatgttaagttattagctggttacatcagtgcagcctcttctaaagctattaaatacctggatatagcttcccaggtgaagtaggaatgtttcatatgccctacatttttttatttttatgaggaaacagtggtagtgaataataaagcatctttaaaaaacaccttatgtgtatatagacatgcatatatcagctcattccctctgttggatgataagggaaatatcctccagacttcaaggtacatgccactcattaggcaccccattgcttctaagtttacttcaagccctttgaaaaggattatgtaggatggcatttattgtttaaaggatagagcttccataatatgatagagatattatatcggaaactcatttcgtctcaaactaccacttagagtgtataagaaaaaaaacccaagcatgtcgattcattaagtctgtcttgtgcatttgtgtgtactgggtacagtgtcaggtaccagggaatcaaacgcacattagaggcagtccccacctccataacgccagacatctaacggtaaaccatttgcacagacatcaggtctcagaactttaaaaaccccacacatgtgaatcttcttgggctcgaaaaataacataatcgagttctgaacaatagttaagaactctattgtaataactatattgggattttatgtctcctcagaacacttgagtaatttatcttttcataactacttccattcctagccaccccacctcctggaatccctatttttttctgatatttctcctggtttcttccttggaaaagccatgtgtacccatctaaggacacaaagcattgtcccagatttcccaccgcccctttgatctcctcacaagtggccaaatatccctggcaatctgtagttgtaagaaactattcaggagtaggagcttcagggtgtagtggtaccgtggtacctgcctttgatctcagcagcagggagacagaggcaggtggatccctgtgaattcaggcctgacctggtctatataaggagttacaggacagccagggctatacactgaaaccctgtctcaaaacaaaagtagaagcttaaaaacaaaactaaaaaccaaacaaacaagtaaactacttggacttccttgcagtgttaagaaatcaaaatattgaagcgtgtctgatttctttgagaaaggaatcatgacctaggttcatatgtatattatcagagaatttagctttgaagagatataagtcctatgcttgtatagcagagtcacattttaatgaattttccccctttggctgttaagagatctaaacgtatcataacgtaatccttgacttcaactcctctgagtgaccatgtggcgatcattccatgaagctgacaagcaaacttatgctgcgtaggttgttttacagggtgaaggggaaagtgggcagccaggcctttgcacactgcaagttgcctcaggcagggtcaggcaatggagatctgtatcggtttggcttgcccacaagacccagaatgtttatcactgtgtacaagtcagtatgtgtgagtcttagcaaaaataagacatgatcagtttgtttcagctaagtgattacaactgtttcagaactaagaagacaccaccttgttaacatacacacttcggtgttgtgttgtagagtcagcaaaactctctagcatttagaatattcttttcattgtgttctaagggtggagttatcctcataacgacaacagaaagaagagtagcaaaatcattttataaaaatcgcttgctggactttaagctcctgcttaatgctgagtatgttccagatatttcatgtatgtatttaataaagtaaaatataccatgcattccacatcgtcttacctgctagagtcaagagccgaactttgcaagggtaggtaaccctcacatatgttcataataagttctttttttggggggagagggaggttcaagacagggtttctctgtatagccctggctgtcctggaactcgctttgtagaacaggctggcctcaaactcagaaatctgcttgcctctgcctcccgagtgctgggattaaaggcgtgcaccaccacgtccggctctcatgataaattcgaatgtatataaaacagacagccaagattactctttgattcccagaagccttgccttcctgaaatgccacacaccacactttggtagtctgtgctagacaatgatacaccttttggcttatttttctttcaaactctaggaaatacttctatgtatatgatctatggctccttaagatgcttaatcataaactgttctacttagaaaatgagctttttaagaagtcttcatgctgtaaaaactttggtggcactataacaaaaaagacatcttcgaatatttggcattaatgtgtaattttaatgatactttgcagaatttttagaggtgtttaactactgctccccagcttagcaccaggacacacaactcaaaccctttgtatggtaaagctgttgttattaaaaagtgaatttaatacacactgtcgtttgagcatcctaccttagcaactcaacagccacgtccatcaaggaacatgtctataggaagatgtttagcatgtgatgcttaaaacacctggatatataggggaactttcactaaaaactcatttatttttcatatgccatgaaatatgtttaactgattaaaatgttttctaagagaagcttgtga

SEQ ID NO: 176 - protein, 430 aa, Mus musculus
MHPSTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQSLCPAPPSSPGHVFPQSPCPTSYPHSPGSPSESDSPYQHSDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 177 - DNA, 3828 bp, Homo sapiens
atatgatgggaggcagccaatgactccgcggcgctcctccgggggccctcagtgtgcgtttgaggagaacaaaaaagagagagagagccgagcgggggagcgatcgagggagctgagccgagagaaagagccgccgggcgctgcctcgccagacctcgctgggaccccggggccaccgggaggcacttttgtggaggggggagggggggcgacctcggcagcctcggcgcacgaagcgtccgagggcagcgtggggcgggctgcgacctctgcatcggtggactgcatttttaattaaggattcccagcagctctttgggatttttacagcttccactcatgtgttgacacccgcgtccaggagaaactcgctccaagtgcatctagcgcctgggacctgagacggcgttggcctttcgtgcatgcaaatccagggatttaggttttgtttgggatttccttttctttctttccttttttttttctttttgcagggagtaagaagggagctgggggtatcaacaagcctgcctttcggatcctgcgggaaaagcccatgtagttaagcgctttggtttaaaaaaaaggcaaggtaaaggcagggctttccagacacatttaggggttcgcgcgagcgctttgtgctcatggaccagccgcacaacttttgaaggctcgccggcccatgtggggtctttctggcggcgcgccgcctgcagcccccctaaagcgcgggggctggagttgttgagcagccccgccgctgtggtccatgtagccgctggccgcgcgcggactgcggctcggcgtgcgcgtgttcccggccgtcccgcctcggcgagctccctcatgttgtcgccctgcggcgccccttcgacgacaggctgtgcgcggtctgcacggcgctccgcggcggagcttcatgtggggctgcgacccgcgcagccggcgcctcgctgagggaacggacccccggtaaccggagaccgcctcccccccacccctggcgccaaaggatatcgtatgttcaggtccaaacgctcggggctggtgcggcgactttggcgaagtcgtgtggtccccgaccgggaggaaggcggcagcggcggcggcggtggcggcgacgaggatgggagcttgggcagccgagctgagccggccccgcgggcaagagagggcggaggctgcggccgctccgaagtccgcccggtagccccgcggcggccccgggacgcagtgggacagcgaggcgcccagggcgcggggaggcgccggcgcgcagggggccccccgaggcccatgtcggagccaggggccggcgctgggagctccctgctggacgtggcggagccgggaggcccgggctggctgcccgagagtgactgcgagacggtgacctgctgtctcttttcggagcgggacgccgccggcgcgccccgggacgccagcgaccccctggccggggcggccctggagccggcgggcggcgggcggagtcgcgaagcgcgctcgcggctgctgctgctggagcaggaactcaaaaccgtcacgtactcgctgctgaagcggctcaaggagcgctcgctggacacgctgctggaggcggtggagtcccgcggcggcgtgccgggcggctgcgtgctggtgccgcgcgccgacctccgcctgggcggccagcccgcgccgccgcagctgctgctcggccgcctctttcgctggcccgacctgcagcacgccgtggagctgaagcccctgtgcggctgccacagcttcgccgccgccgccgacggccctaccgtgtgctgcaacccctaccacttcagccggctctgcgggcccgaatctccgccacctccctactctcggctgtctcctcgcgacgagtacaagccactggatctgtccgattccacattgtcttacactgaaacggaggctaccaactccctcatcactgctccgggtgaattctcagacgccagcatgtctccggacgccaccaagccgagccactggtgcagcgtggcgtactgggagcaccggacgcgcgtgggccgcctctatgcggtgtacgaccaggccgtcagcatcttctacgacctacctcagggcagcggcttctgcctgggccagctcaacctggagcagcgcagcgagtcggtgcggcgaacgcgcagcaagatcggcttcggcatcctgctcagcaaggagcccgacggcgtgtgggcctacaaccgcggcgagcaccccatcttcgtcaactccccgacgctggacgcgcccggcggccgcgccctggtcgtgcgcaaggtgccccccggctactccatcaaggtgttcgacttcgagcgctcgggcctgcagcacgcgcccgagcccgacgccgccgacggcccctacgaccccaacagcgtccgcatcagcttcgccaagggctgggggccctgctactcccggcagttcatcacctcctgcccctgctggctggagatcctcctcaacaaccccagatagtggcggccccggcgggaggggcgggtgggaggccgcggccaccgccacctgccggcctcgagaggggccgatgcccagagacacagcccccacggacaaaaccccccagatatcatctacctagatttaatataaagttttatatattatatggaaatatatattatacttgtaattatggagtcatttttacaatgtaattatttatgtatggtgcaatgtgtgtatatggacaaaacaagaaagacgcactttggcttataattctttcaatacagatatattttctttctcttcctccttcctcttccttactttttatatatatatataaagaaaatgatacagcagagctaggtggaaaagcctgggtttggtgtatggtttttgagatattaatgcccagacaaaaagctaataccagtcactcgataataaagtattcgcattatagttttttttaaactgtcttctttttacaaagaggggcaggtagggcttcagcggatttctgacccatcatgtaccttgaaacttgacctcagttttcaagttttacttttattggataaagacagaacaaattgaaaagggaggaaagtcacatttactcttaagtaaaccagagaaagttctgttgttccttcctgcccatggctatggggtgtccagtggatagggatggcggtggggaaaagaatacactggccatttatcctggacaagctcttccagtctgatggaggaggttcatgccctagcctagaaaggcccaggtccatgccccccatctttgagttatgagcaagctaaaagaagacactatttctcaccattttgtggaaatggcctggggaacaaagactgaaatgggccttgagcccacctgctaccttgcagagaaccatctcgagccccgtagatctttttaggacctccacaggctatttcccaccccccagccaaaaatagctcagaatctgcccatccagggctgtattaatgatttatgtaaaggcagatggtttatttctactttgtgaaagggaaaagttgaggttctggaaggttaaatgatttgctcatgagacaaaatcaaggttagaagttacatggaattgtaggaccagagccatatcattagatcagctttctgaagaatattctcaaaaaaagaaagtctccttggccagataactaagaggaatgtttcattgtatatcttttttcttggagatttatattaacatattaagtgctctgagaagtcctgtgtattatctcttgctgcataataaattatccccaaactta

SEQ ID NO: 178 - protein, 496 aa, Homo sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 179 - DNA, 2971 bp, Mus musculus
agactggcatatgatgggaggcagccaatgactccgcggcgctcctccgggggccctcagtgtgcgtttgaggagaacaaaaaagagagagagcgccgagagggggaacgagcgagggagctgagtccagagaaagagccgccgggcgctgcctcgccaaacctcgctgggaccgcggggccaccaggaggcactttggtgaaggggggggggggcgacctcggcagccgcggcgcccgaagcgacccagcgcagcgtggggcgggctgcgacctctgcttcggtggattgcatttttaattaaggattcctagcagctctttgggattttttttttccggcttccactcatgtgttgacacccgcgttcaggagagacttgccccaagtgcaccgagcgcccgggacctgagacggaattgcttttcgtgcgtgcaaaatccaagcattttgagttttgtttgggacctttttcttgctttgcttttatttctatttttattttgttgcagggatatgggagttatccacaagccttagtttcggatcctgcagggaaagcccatgtagcatagcttggcttttgaaggcagagttgtgcagacacatttgggggcacgacgcaagcgctttgtgctcgtgtaccagccgcgcaacttttgaaggctcgccggcccatgcagggtgtctctagcatcgtttcgctggtggcttccctaaggctccaaagcagctggagttgagcggtcccggcccatcgtgatccatgtagcccgctggtccctcgcggactgaggctcaacacgcgcgtgttcccggcccggcccggcccggcttggcccggcgcgagctccctcatgttgcagccctgcggtgccccttcgacgacaggctgtgcgcggtctgcacggcgccccgcggcagagcttcatgtggggctgcggcccgctcagccggcgcctcgttgagggaacggacccccggtaaccggagaccgcctcccctcccaccaccccaggcgccaaagggtatcgtatgttcaggtctaaacgttcggggctggtgcggcgactttggcgaagtcgtgtggtccctgatcgggaggaaggcagcggcggcggcggtggtgtcgacgaggatgggagcctgggcagccgagctgagcctgccccgcgggcacgagagggcggaggctgcagccgctccgaagtccgctcggtagccccgcggcggccccgggacgcggtgggaccgcgaggcgccgcgatcgcgggcaggcgccggcgcacagggggcctcccgaggcccgtgtcggagtcgggggccggggctgggggctccccgctggatgtggcggagcctggaggcccaggctggctgcctgagagtgactgcgagacggtgacctgctgtctcttctccgaacgggacgcagcaggcgcgccccgggactctggcgatccccaagccagacagtccccggagccggaggagggcggcgggcctcggagtcgcgaagcccgctcgcgactgctgcttctggagcaggagctcaagacggtcacgtactcgctgctcaagaggctcaaggagcgttcgctggacacgctgttggaggctgtggagtcccgaggcggcgtaccgggcggctgcgtgctggtgccgcgcgccgacctccgcttgggcggccagcccgcgccaccgcagctgctgctcggccgcctcttccgctggccagacctgcagcacgcagtggagctgaaacccctgtgcggctgccacagctttaccgccgccgccgacgggcccacggtgtgttgcaacccctaccacttcagccggctctgcgggccagaatcaccgccgcccccctattctcggctgtctcctcctgaccagtacaagccactggatctgtccgattctacattgtcttacactgaaaccgaggccaccaactccctcatcactgctccgggtgaattctcagatgccagcatgtctccggatgccaccaagccgagccactggtgcagcgtggcgtactgggagcaccggacacgcgtgggccgcctctatgcggtgtacgaccaggctgtcagcattttctacgacctacctcagggcagcggcttctgcctgggccagctcaacctggagcagcgcagtgagtcggtgcggcgcacgcgcagcaagatcggttttggcatactgctcagcaaggagccagacggcgtgtgggcctacaaccggggcgagcaccccatcttcgtcaactccccgacgctggatgcgcccggaggccgcgccctggtcgtgcgcaaggtgccaccgggttactccatcaaggtgttcgactttgagcgctcagggctgctgcagcacgcagacgccgctcacggcccctacgacccgcacagtgtgcgcatcagcttcgccaagggctggggaccctgctactcgcgacagttcatcacctcctgcccctgttggctggagatcctactcaacaaccacagatagcaatgcggctgccactgtgccgcagcgtcccccaacctctggggggccagcgcccagagacaccaccccagggacaacctcgccctccccccagatatcatctacctagatttaatataaagttttatatattatatggaaatatatattatacttgtaattatggagtcatttttacaacgtaattatttatatatggtgcaatgtgtgtatatggagaaacaagaaagacgcactttggcttgtaattctttcaatacagatatatttttttctttctttccctctttccttttttaaagagaattatacagtagaactaggtggaaagcctaggtttggtgtatggcttttttaaaaaatattaatgcccagaccaaaaaaaaacaaaacaaaaaacaaaaaaactaataccagtcactcttgataataaagtgtttgcattata

SEQ ID NO: 180 - protein, 495 aa, Mus musculus
MFRSKRSGLVRRLWRSRVVPDREEGSGGGGGVDEDGSLGSRAEPAPRAREGGGCSRSEVRSVAPRRPRDAVGPRGAAIAGRRRRTGGLPRPVSESGAGAGGSPLDVAEPGGPGWLPESDCETVTCCLFSERDAAGAPRDSGDPQARQSPEPEEGGGPRSREARSRLLLLEQELKTVTYSLLKRLKERSLDTLLEAVESRGGVPGGCVLVPRADLRLGGQPAPPQLLLGRLFRWPDLQHAVELKPLCGCHSFTAAADGPTVCCNPYHFSRLCGPESPPPPYSRLSPPDQYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLLQHADAAHGPYDPHSVRISFAKGWGPCYSRQFITSCPCWLEILLNNHR

SEQ ID NO: 181 - DNA, 3088 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 182 - protein, 426 aa, Homo sapiens
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 183 - DNA, 3085 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactagagtctcccccccctccttactccagatacccgatggattttctcaaaccaactgactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 184 - protein, 425 aa, Homo sapiens
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTDCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 185 - DNA, 2292 bp, Homo sapiens
agtaaatacggagaatcacgtcgaacaccagtggcccagatactgtcgtggccgcgcacctttggagttttggggcaaagagagttggatggaaggccgaactggagtctcccccccctccttactccagatacccgatggattttctcaaaccaactgcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttga

SEQ ID NO: 186 - protein, 211 aa, Homo sapiens
MDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 187 - DNA, 2386 bp, Homo sapiens
agtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttgaa

SEQ ID NO: 188 - protein, 238 aa, Homo sapiens
MCGLSFMLFRACLKMDLGVFICVFISFSPLFKSTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 189 - DNA, 4441 bp, Mus musculus
ttcgctcgctgatcggcgcacagaggatcttgtccccgagctgcgccagcagagccagccgggcgcctcgctcggtccgctcgccgcgccggagagagctgcctgagacgcagccagccagccagccggcgccacgccgccgagcgctcggccccggagtccctgagtgcggcgcggcgagcccccagcggcggcagaaggactcgagcgccaggagagggcggacgggggacgaggaggctccggggcgcgacgaagagagtctccgaggaagaggctgcgagaggacacccgggcctcctgccgccactgtcgggtcggggccagcagctcatgagagcagccccggcggccacccgcggccaggagaaggagcaccggaggcccccacactagcctgtgccctcgggggcgagagcttgcgacccgccggagcccgccgccgcgccgccctcccccgcgctgacagccccccggggcgcagccgccgccgcagcatcttctgtccctgcttccccagcgcggaggaagtccccgccgaggacctgggcccccgggaacgcaggaggaaagaccagagactctaaaacacccagatacgcaagattgaagcagcctagccagacctttctgtggattaaaagaaatacgattttttttttttttttggcagaagaaaaggaaaggaagaccggctgggttcagcaaggaaaaaaagggggatgtaactcgtggatacggtttttttcccccacccttccaacatcttgttttactttgtaaacattttctcttttaaacccgggctccatccggtgccctccagacctccgaggtgcgaggaggtggtgtgttttttcattgggggctttgcatattttggttttgggggttttgagagaccctccagacatctcacgaggggtgaagtctactcggtcccctccctcaagtcttcgcgtgcacagaattcgaggagatccggttactaaggatatagaagaaaaaaaataaatcgtgcctgccttttttttttaattgcctgcttctccccacccccaaattaagttgcttagcaagggggaaagaggctttttcctccctttagtagctcagcctaacgtctttcgtttttttttttttttttttgcccccgaggatcttccatgtaggaagccgaggctggcgagcccgacactcgggagccactgtaggggggccttttttgggggaggcgtctaccggggttgcctcggccgcccccagggaagcggcggccgcgttcctccagggcacgccggggcccgaaagccgcgcagggcgcgggccgcgccgggtggggcagccgaagcgcagccccccgatccccggcaggcgcccctgggcccccgcgcgcgccccggcctctgggagactggcgcatgccacggagcgcccctcgggccgccgccgcttctgcccgggcccctgctgttgctgctgtcgcctgcgcctgctgccccaactcggcgcccgacttcttcatggtgtgcggaggtcatgttcgctccttagccggcaaacgacttttctcctcgcctcctcgccccgcatgttcaggaccaaacgatctgcgctcgtccggcgtctctggaggagccgtgcgcccggcggcgaggacgaggaggagggcgtggggggtggcggcggaggaggcgagctgcggggagaaggggcgacggacggccgggcttatggggctggtggcggcggtgcgggcagggctggctgctgcctgggcaaggcagtccgaggtgccaaaggtcaccaccatccccatcccccaacctcgggtgccggggcggccgggggcgccgaggcggatctgaaggcgctcacgcactcggtgctcaagaaactcaaggagcggcagctggagctgctgcttcaggccgtggagtcccgcggcggtacgcgcaccgcgtgcctcctgctgcccggccgcctggactgcaggctgggcccgggggcgcccgccagcgcgcagcccgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagtcgactctgtgaactagagtctccccctcctccttactccagatacccaatggattttctcaaaccaactgcaggctgtccagatgctgtaccttcctccgcggaaaccgggggaacgaattatctggcccctggggggctttcagattcccaacttcttctggagcctggggatcggtcacactggtgcgtggtggcatactgggaggagaagactcgcgtggggaggctctactgtgtccaagagccctccctggatatcttctatgatctacctcaggggaatggcttttgcctcggacagctcaattcggacaacaagagtcagctggtacagaaagtgcggagcaagatcggctgtggcatccagctgacgcgggaagtggatggcgtgtgggtttacaaccgcagcagttaccccatcttcatcaagtccgccacactggacaacccggactccaggacgctgttggtgcacaaagtgttccctggtttctccatcaaggcttttgactatgagaaagcctacagcctgcagcggcccaatgaccacgagttcatgcagcaaccatggacgggtttcaccgtgcagatcagctttgtgaagggctggggccagtgctacacccgccagttcatcagcagctgcccgtgctggctggaggtcatcttcaacagccggtagtcggtcgtgtggtggggagaagaggacagggcggatcgtgagccgagcaggccaccgttcaaactacttgctgctaacctttcccgagtgattgcttttcatgcaaactctttggttggtgttgttattgccattcattgttggttttgttttgttctgttctggtttgtttttttttttttttcctcctcctttctcgtcatccgtgtgtcccgcttgtcttgttctttgagaaattagcttatggtgcggatttttgttgggttgtgtgtgtgtgttttgtttttgttttgaggtggtgggtgtggttggcaggacaccccctccccccatatacgaagacaggaaacgagagtcagcactgccaagcatggtgtgtgaaagtgggcaccaccttccctttggatcagcgtttcggttgtccgtgcgtaggggtgtacccgagcgacagatgggggaagtgcttttttgtgtgtgtgttctttatggatgcccccggctgagaggctcatagtgccaagctgtgtgtctctctagccttttggacacgctcggtggggcagaggcagtacctgggcagactggcagcaggtgccaagctctgctccagcctgccgaagctgccccgccccgccccgcccccgcccccacaggacacgggcctatccacaggcttctgagaagccagcctgctagaaggctgaaccagaaccaattgttttcatccctgtcttactgccgcctgtcacccgctgccattgtcgagtctgtcttttttggccatctgctcctggatctctctcttgagatgggcttcccaagggctgccgggacagccccagtcacagtattgctaccccagtaccctctcaggcccttccaccgggtcccagccgtggtggttttttcatcaggtttctcccagatgtggaaagtcagctcagcaccccatcccccatcctgtgtgctgagctctgtagaccagcgaggggcatcagggagggacctgcgcagtgcccccccttcctgctgagaagggtgtagccccgtcacaacaaaggtaccatcccttggctggctcccagcccttctctcagctcatacgctcgctcgtatgatactttgacactgttcttagctcaatgagcatgtttagaatttaacataagctatttttctaactacaaaggtttaaatgaacaagagaagcattctcattggaaatttagcattgtagtgctttgagagaggaaaggactccttaaaagaaaaaaaaagctgagatttattaaagaaaaatgtattttatgttatatataaatatattattacttgtaaatataaagacgttttataagcatcattatttatgtattgtgcaatgtgtataaacgagaagaataaagaaaagatgcactttgctttaatataaatgcaaataacatgccaaattaaaaaaaaaaagataaacacaagattggtgtttttttctatgggtgttatcacctagctgaatgtttttctaaaggagtttatgttccattaaacaatttttaaaatgtatactgc

SEQ ID NO: 190 - protein, 426 aa, Mus musculus
MFRTKRSALVRRLWRSRAPGGEDEEEGVGGGGGGGELRGEGATDGRAYGAGGGGAGRAGCCLGKAVRGAKGHHHPHPPTSGAGAAGGAEADLKALTHSVLKKLKERQLELLLQAVESRGGTRTACLLLPGRLDCRLGPGAPASAQPAQPPSSYSLPLLLCKVFRWPDLRHSSEVKRLCCCESYGKINPELVCCNPHHLSRLCELESPPPPYSRYPMDFLKPTAGCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 191 - DNA, 19 bp, Artificial Sequence
  Description of Artificial Sequence: Synthetic primer
atggccgacattgccagtg

SEQ ID NO: 192 - DNA, 22 bp, Artificial Sequence
  Description of Artificial Sequence: Synthetic primer
cggtagtaatccccgttgtaga

SEQ ID NO: 193 - DNA, 19 bp, Artificial Sequence
  Description of Artificial Sequence: Synthetic primer
cagagccccaaggacgatg

SEQ ID NO: 194 - DNA, 23 bp, Artificial Sequence
  Description of Artificial Sequence: Synthetic primer
gcacaaagttcataggacacagc

SEQ ID NO: 195 - DNA, 23 bp, Artificial Sequence
  Description of Artificial Sequence: Synthetic primer
ttaaaaacctggatcggaaccaa

SEQ ID NO: 196 - DNA, 23 bp, Artificial Sequence
  Description of Artificial Sequence: Synthetic primer
gcattagcttcagatttacgggt

SEQ ID NO: 197 - DNA, 21 bp, Artificial Sequence
  Description of Artificial Sequence: Synthetic primer
gctgctttcagcatccaagtg

SEQ ID NO: 198 - DNA, 19 bp, Artificial Sequence
  Description of Artificial Sequence: Synthetic primer
ccagggacaccgactactg

SEQ ID NO: 199 - DNA, 19 bp, Artificial Sequence
  Description of Artificial Sequence: Synthetic primer
ctgggccagataaggctcc

SEQ ID NO: 200 - DNA, 21 bp, Artificial Sequence
  Description of Artificial Sequence: Synthetic primer
catggggcactggatattgtt

SEQ ID NO: 201 - DNA, 20 bp, Artificial Sequence
  Description of Artificial Sequence: Synthetic primer
tgtacgagtcggtgtgcttc

SEQ ID NO: 202 - DNA, 23 bp, Artificial Sequence
  Description of Artificial Sequence: Synthetic primer
ggtaggtatccgtcatggtcttg

SEQ ID NO: 203 - DNA, 22 bp, Artificial Sequence
  Description of Artificial Sequence: Synthetic primer
ctctgtccttaaagcggcttac

SEQ ID NO: 204 - DNA, 21 bp, Artificial Sequence
  Description of Artificial Sequence: Synthetic primer
gttgcggaggttcaagatgtt

SEQ ID NO: 205 - DNA, 21 bp, Artificial Sequence
  Description of Artificial Sequence: Synthetic primer
ctctccacctacagcctgatt

SEQ ID NO: 206 - DNA, 23 bp, Artificial Sequence
  Description of Artificial Sequence: Synthetic primer
agaacatcgtaaggatgcagttg

SEQ ID NO: 207 - DNA, 19 bp, Artificial Sequence
  Description of Artificial Sequence: Synthetic primer
ccgaagcgcacttcacagt

SEQ ID NO: 208 - DNA, 23 bp, Artificial Sequence
  Description of Artificial Sequence: Synthetic primer
gcagatacagagaggtttcctca

SEQ ID NO: 209 - DNA, 21 bp, Artificial Sequence
  Description of Artificial Sequence: Synthetic primer
tcctagctgtcactcaaggga

SEQ ID NO: 210 - DNA, 22 bp, Artificial Sequence
  Description of Artificial Sequence: Synthetic primer
tcagagaacttccaggtgaaga

SEQ ID NO: 211 - DNA, 22 bp, Artificial Sequence
  Description of Artificial Sequence: Synthetic primer
tgtcatctgtgaaaaggtggtc

SEQ ID NO: 212 - DNA, 20 bp, Artificial Sequence
  Description of Artificial Sequence: Synthetic primer
actggagcagcggtgttatg

SEQ ID NO: 213 - DNA, 22 bp, Artificial Sequence
  Description of Artificial Sequence: Synthetic primer
cagaaacgcctaagcctagttg

SEQ ID NO: 214 - DNA, 22 bp, Artificial Sequence
  Description of Artificial Sequence: Synthetic primer
atgcaggatcaggtttagatgc

SEQ ID NO: 215 - DNA, 20 bp, Artificial Sequence
  Description of Artificial Sequence: Synthetic primer
agtgcgacgagaacggtaac

SEQ ID NO: 216 - DNA, 19 bp, Artificial Sequence
  Description of Artificial Sequence: Synthetic primer
cgttggggaacacacacca

SEQ ID NO: 217 - DNA, 19 bp, Artificial Sequence
  Description of Artificial Sequence: Synthetic primer
ccgttgacccgctttctgt

SEQ ID NO: 218 - DNA, 21 bp, Artificial Sequence
  Description of Artificial Sequence: Synthetic primer
cggcgtccattttctttggaa

SEQ ID NO: 219 - DNA, 21 bp, Artificial Sequence
  Description of Artificial Sequence: Synthetic primer
acccccaacataactgagtct

SEQ ID NO: 220 - DNA, 21 bp, Artificial Sequence
  Description of Artificial Sequence: Synthetic primer
ttccaaccaagagaagcgagg

SEQ ID NO: 221 - DNA, 23 bp, Artificial Sequence
  Description of Artificial Sequence: Synthetic primer
ctggactctacgacttcacaatg

SEQ ID NO: 222 - DNA, 21 bp, Artificial Sequence
  Description of Artificial Sequence: Synthetic primer
agttggcgatcactgacagtt

SEQ ID NO: 223 - DNA, 19 bp, Artificial Sequence
  Description of Artificial Sequence: Synthetic primer
ccgttgacccgctttctgt

SEQ ID NO: 224 - DNA, 21 bp, Artificial Sequence
  Description of Artificial Sequence: Synthetic primer
cggcgtccattttctttggaa

SEQ ID NO: 225 - DNA, 20 bp, Artificial Sequence
  Description of Artificial Sequence: Synthetic primer
ttccctggggaggactactg

SEQ ID NO: 226 - DNA, 21 bp, Artificial Sequence
  Description of Artificial Sequence: Synthetic primer
tgtatgcttgccccgtgaaat

SEQ ID NO: 227 - DNA, 21 bp, Artificial Sequence
  Description of Artificial Sequence: Synthetic primer
gaagtgccaatcccctagcaa

SEQ ID NO: 228 - DNA, 23 bp, Artificial Sequence
  Description of Artificial Sequence: Synthetic primer
cagtcactacctgaatggagaga

SEQ ID NO: 229 - DNA, 22 bp, Artificial Sequence
  Description of Artificial Sequence: Synthetic primer
tccttgatccttctttcttgcc

SEQ ID NO: 230 - DNA, 21 bp, Artificial Sequence
  Description of Artificial Sequence: Synthetic primer
acagtgccacacagcttcttc

SEQ ID NO: 231 - DNA, 23 bp, Artificial Sequence
  Description of Artificial Sequence: Synthetic primer
atcaaacctttagtgcagagtgg

SEQ ID NO: 232 - DNA, 21 bp, Artificial Sequence
  Description of Artificial Sequence: Synthetic primer
ctgtattccccgttgtgtagc

SEQ ID NO: 233 - DNA, 21 bp, Artificial Sequence
  Description of Artificial Sequence: Synthetic primer
ccaagtgctgccgtcattttc

SEQ ID NO: 234 - DNA, 21 bp, Artificial Sequence
  Description of Artificial Sequence: Synthetic primer
ggctcgcagggatgatttcaa

SEQ ID NO: 235 - DNA, 23 bp, Artificial Sequence
  Description of Artificial Sequence: Synthetic primer
taccttgaggttagtgaacgtca

SEQ ID NO: 236 - DNA, 22 bp, Artificial Sequence
  Description of Artificial Sequence: Synthetic primer
cgctctcgttttccccataatc

SEQ ID NO: 237 - DNA, 21 bp, Artificial Sequence
  Description of Artificial Sequence: Synthetic primer
acctccatcccgaactacaac

SEQ ID NO: 238 - DNA, 20 bp, Artificial Sequence
  Description of Artificial Sequence: Synthetic primer
cgccacaaacagtgtcactc

SEQ ID NO: 239 - DNA, 19 bp, Artificial Sequence
  Description of Artificial Sequence: Synthetic primer
tgctggcttccgagtcttc

SEQ ID NO: 240 - DNA, 19 bp, Artificial Sequence
  Description of Artificial Sequence: Synthetic primer
cggggtcgttctcgaacac

SEQ ID NO: 241 - DNA, 19 bp, Artificial Sequence
  Description of Artificial Sequence: Synthetic primer
agccccatcactgtggagt

SEQ ID NO: 242 - DNA, 20 bp, Artificial Sequence
  Description of Artificial Sequence: Synthetic primer
gatgccgctcaacatcttgc

SEQ ID NO: 243 - DNA, 21 bp, Artificial Sequence
  Description of Artificial Sequence: Synthetic primer
ccctgacctggcagttgaatg

SEQ ID NO: 244 - DNA, 21 bp, Artificial Sequence
  Description of Artificial Sequence: Synthetic primer
agctccaatgatggccatagc

SEQ ID NO: 245 - DNA, 22 bp, Artificial Sequence
  Description of Artificial Sequence: Synthetic primer
gagatcgactctctgttcgagg

SEQ ID NO: 246 - DNA, 19 bp, Artificial Sequence
  Description of Artificial Sequence: Synthetic primer
gcccgttgaagaagtcctg

SEQ ID NO: 247 - DNA, 21 bp, Artificial Sequence
  Description of Artificial Sequence: Synthetic primer
atgaagccgtacttctgccat

SEQ ID NO: 248 - DNA, 22 bp, Artificial Sequence
  Description of Artificial Sequence: Synthetic primer
cgcatttttaactgctggacag

SEQ ID NO: 249 - DNA, 21 bp, Artificial Sequence
  Description of Artificial Sequence: Synthetic primer
cagctccaagaaaggacgaac

SEQ ID NO: 250 - DNA, 21 bp, Artificial Sequence
  Description of Artificial Sequence: Synthetic primer
ggcagtgtaactcttctgcat

SEQ ID NO: 251 - DNA, 21 bp, Artificial Sequence
  Description of Artificial Sequence: Synthetic primer
atgaacgctacacactgcatc

SEQ ID NO: 252 - DNA, 21 bp, Artificial Sequence
  Description of Artificial Sequence: Synthetic primer
ccatccttttgccagttcctc

SEQ ID NO: 253 - DNA, 21 bp, Artificial Sequence
  Description of Artificial Sequence: Synthetic primer
tggtttgccatcgttttgctg

SEQ ID NO: 254 - DNA, 22 bp, Artificial Sequence
  Description of Artificial Sequence: Synthetic primer
acaggtgaggttcactgtttct

SEQ ID NO: 255 - DNA, 20 bp, Artificial Sequence
  Description of Artificial Sequence: Synthetic primer
gtgaaccccagaccagactg

SEQ ID NO: 256 - DNA, 22 bp, Artificial Sequence
  Description of Artificial Sequence: Synthetic primer
cctggaacacgtttctgaaaga

SEQ ID NO: 257 - DNA, 22 bp, Artificial Sequence
  Description of Artificial Sequence: Synthetic primer
gaaatgccaccttttgacagtg

SEQ ID NO: 258 - DNA, 21 bp, Artificial Sequence
  Description of Artificial Sequence: Synthetic primer
tggatgctctcatcaggacag

SEQ ID NO: 259 - DNA, 22 bp, Artificial Sequence
  Description of Artificial Sequence: Synthetic primer
aaccatagtacccagttgtcgg

SEQ ID NO: 260 - DNA, 23 bp, Artificial Sequence
  Description of Artificial Sequence: Synthetic primer
tcctaagcaacgcatatagacca

SEQ ID NO: 261 - DNA, 19 bp, Artificial Sequence
  Description of Artificial Sequence: Synthetic primer
tggagcctgtccctctacg

SEQ ID NO: 262 - DNA, 21 bp, Artificial Sequence
  Description of Artificial Sequence: Synthetic primer
tccacatgcaagagacattgg

SEQ ID NO: 263 - DNA, 21 bp, Artificial Sequence
  Description of Artificial Sequence: Synthetic primer
ccgtgtggttacatctaccct

SEQ ID NO: 264 - DNA, 22 bp, Artificial Sequence
  Description of Artificial Sequence: Synthetic primer
cgtggttctgttgatgacagtg

SEQ ID NO: 265 - DNA, 20 bp, Artificial Sequence
  Description of Artificial Sequence: Synthetic primer
atgccaatcactcgaatgcg

SEQ ID NO: 266 - DNA, 21 bp, Artificial Sequence
  Description of Artificial Sequence: Synthetic primer
ttgtatcggcctgtgtgaatg

SEQ ID NO: 267 - DNA, 20 bp, Artificial Sequence
  Description of Artificial Sequence: Synthetic primer
tccgacagtggttgatcgac

SEQ ID NO: 268 - DNA, 22 bp, Artificial Sequence
  Description of Artificial Sequence: Synthetic primer
cctcacgattgtagtcctgctt

SEQ ID NO: 269 - DNA, 20 bp, Artificial Sequence
  Description of Artificial Sequence: Synthetic primer
cggggctgatctgggaaaat

SEQ ID NO: 270 - DNA, 20 bp, Artificial Sequence
  Description of Artificial Sequence: Synthetic primer
cacagcgtaacctcgtcttc

SEQ ID NO: 271 - DNA, 19 bp, Artificial Sequence
  Description of Artificial Sequence: Synthetic primer
tgcagagggcgaacagaac

SEQ ID NO: 272 - DNA, 19 bp, Artificial Sequence
  Description of Artificial Sequence: Synthetic primer
gcacacgtcaccactttgc

SEQ ID NO: 273 - DNA, 23 bp, Artificial Sequence
  Description of Artificial Sequence: Synthetic primer
cctgtgcagcatgtaaaagaatg

SEQ ID NO: 274 - DNA, 22 bp, Artificial Sequence
  Description of Artificial Sequence: Synthetic primer
caaggatcggcagttcagatac

SEQ ID NO: 275 - DNA, 21 bp, Artificial Sequence
  Description of Artificial Sequence: Synthetic primer
atggacgctgatggcaatacc

SEQ ID NO: 276 - DNA, 19 bp, Artificial Sequence
  Description of Artificial Sequence: Synthetic primer
tccccattcacgtctccca

SEQ ID NO: 277 - DNA, 20 bp, Artificial Sequence
  Description of Artificial Sequence: Synthetic primer
gcccctgcaaagataccgaa

SEQ ID NO: 278 - DNA, 23 bp, Artificial Sequence
  Description of Artificial Sequence: Synthetic primer
tctgtgggttctagtcattgagg

SEQ ID NO: 279 - DNA, 23 bp, Artificial Sequence
  Description of Artificial Sequence: Synthetic primer
cagcactctttgaggtgaaaaac

SEQ ID NO: 280 - DNA, 21 bp, Artificial Sequence
  Description of Artificial Sequence: Synthetic primer
acgatctgagaaccattcgca

SEQ ID NO: 281 - DNA, 21 bp, Artificial Sequence
  Description of Artificial Sequence: Synthetic primer
tacgtcggcagactcgatatt

SEQ ID NO: 282 - DNA, 21 bp, Artificial Sequence
  Description of Artificial Sequence: Synthetic primer
tgggcgtatctctctctcctt

SEQ ID NO: 283 - DNA, 21 bp, Artificial Sequence
  Description of Artificial Sequence: Synthetic primer
cacagaactgagcgacttcct

SEQ ID NO: 284 - DNA, 19 bp, Artificial Sequence
  Description of Artificial Sequence: Synthetic primer
cagccaacactgccttgga

SEQ ID NO: 285 - DNA, 23 bp, Artificial Sequence
  Description of Artificial Sequence: Synthetic primer
gagaaaaaccgctgtcagaatgg

SEQ ID NO: 286 - DNA, 21 bp, Artificial Sequence
  Description of Artificial Sequence: Synthetic primer
ggtggagtattggcagtcctc

SEQ ID NO: 287 - DNA, 22 bp, Artificial Sequence
  Description of Artificial Sequence: Synthetic primer
gtaaacgacttccgcactaaga

SEQ ID NO: 288 - DNA, 19 bp, Artificial Sequence
  Description of Artificial Sequence: Synthetic primer
gctgacacgcaataagccg

SEQ ID NO: 289 - DNA, 21 bp, Artificial Sequence
  Description of Artificial Sequence: Synthetic primer
ccgtacctggtcatcacagag

SEQ ID NO: 290 - DNA, 20 bp, Artificial Sequence
  Description of Artificial Sequence: Synthetic primer
cagtctcgaagctcgatggc

SEQ ID NO: 291 - DNA, 20 bp, Artificial Sequence
  Description of Artificial Sequence: Synthetic primer
ccacggggaaggaactgaag

SEQ ID NO: 292 - DNA, 23 bp, Artificial Sequence
  Description of Artificial Sequence: Synthetic primer
acgtattctcctgcgaaactgta

SEQ ID NO: 293 - DNA, 21 bp, Artificial Sequence
  Description of Artificial Sequence: Synthetic primer
ggacttgccttgttccgagag

SEQ ID NO: 294 - DNA, 22 bp, Artificial Sequence
  Description of Artificial Sequence: Synthetic primer
gctgccacataactgatagcga

SEQ ID NO: 295 - DNA, 18 bp, Artificial Sequence
  Description of Artificial Sequence: Synthetic primer
acaaggcccccagagtgt

SEQ ID NO: 296 - DNA, 20 bp, Artificial Sequence
  Description of Artificial Sequence: Synthetic primer
ggaagaagtgggatgcaaga

SEQ ID NO: 297 - DNA, 23 bp, Artificial Sequence
  Description of Artificial Sequence: Synthetic primer
tgagggtcctgataatgtcctac

SEQ ID NO: 298 - DNA, 21 bp, Artificial Sequence
  Description of Artificial Sequence: Synthetic primer
agaggtccaaatgcttgaggc

SEQ ID NO: 299 - DNA, 23 bp, Artificial Sequence
  Description of Artificial Sequence: Synthetic primer
gtgagatacaacgtagctgactg

SEQ ID NO: 300 - DNA, 22 bp, Artificial Sequence
  Description of Artificial Sequence: Synthetic primer
tcctgcatccaagatagcaagt

SEQ ID NO: 301 - DNA, 21 bp, Artificial Sequence
  Description of Artificial Sequence: Synthetic primer
tgagccaagacagaaaaccca

SEQ ID NO: 302 - DNA, 23 bp, Artificial Sequence
  Description of Artificial Sequence: Synthetic primer
gggacatgagtaaggttcctgtt

SEQ ID NO: 303 - DNA, 23 bp, Artificial Sequence
  Description of Artificial Sequence: Synthetic primer
ccctcacactcagatcatcttct

SEQ ID NO: 304 - DNA, 19 bp, Artificial Sequence
  Description of Artificial Sequence: Synthetic primer
gctacgacgtgggctacag

SEQ ID NO: 305 - DNA, 19 bp, Artificial Sequence
  Description of Artificial Sequence: Synthetic primer
gaacagcgatcaggccagg

SEQ ID NO: 306 - DNA, 22 bp, Artificial Sequence
  Description of Artificial Sequence: Synthetic primer
ggacagttgggtgtctcacatt

SEQ ID NO: 307 - DNA, 21 bp, Artificial Sequence
  Description of Artificial Sequence: Synthetic primer
ctcagccttgtgggtaacagc

SEQ ID NO: 308 - DNA, 21 bp, Artificial Sequence
  Description of Artificial Sequence: Synthetic primer
acaggcagtagacaggagaac

SEQ ID NO: 309 - DNA, 23 bp, Artificial Sequence
  Description of Artificial Sequence: Synthetic primer
attgcacatcagactttgaggaa

SEQ ID NO: 310 - DNA, 20 bp, Artificial Sequence
  Description of Artificial Sequence: Synthetic primer
ataatggccgtgtcgcttcg

What is claimed is:

1. A cancer vaccine comprising cancer cells, wherein the cancer cells:

a) lack functional PTEN;
b) lack functional p53; and
c) comprise an activated TGFβ-Smad/p63 signaling pathway by contact with a TGFβ protein.

2. The cancer vaccine of claim 1, wherein a) the TGFβ protein is selected from the group consisting of TGFβ1, TGFβ2, and TGFβ3;
b) the cancer cells are contacted with the TGFβ protein in vitro, in vivo, and/or ex vivo;
c) the cancer cells have increased nuclear localization of Smad2, and/or association of p63 and Smad2 in the nucleus of the cancer cells, relative to cancer cells that have not been contacted with the TGFβ protein;
d) the cancer cells are derived from a solid or hematological cancer;
e) the cancer cells are derived from a cancer cell line;
f) the cancer cells are derived from primary cancer cells;
g) the cancer cells are breast cancer cells;
h) the cancer cells are derived from a triple-negative breast cancer (TNBC);
i) contact with the TGFβ protein induces epithelial-to-mesenchymal (EMT) transition in the cancer cells;
j) contact with the TGFβ protein upregulates the expression levels of ICOSL, PYCARD, SFN, PERP, RIPK3, CASP9, and/or SESN1 in the cancer cells;
k) contact with the TGFβ protein downregulates the expression levels of KSR1, KSR1, EIF4EBP1, ITGA5, EMILIN1, CD200, and/or CSF1 in the cancer cells;
l) The cancer cells are capable of activating co-cultured dendritic cells (DCs) in vitro;
m) the cancer cells are capable of upregulating CD40, CD80, CD86, CD103, CD8, HLA-DR, MHC-II, and/or IL1-β in the co-cultured dendritic cells in vitro;
n) the cancer cells are capable of activating co-cultured T cells in the presence of DCs in vitro;
o) the cancer cells are capable of increasing secretion of TNFα and/or IFNγ by the co-cultured T cells in the presence of DCs in vitro;
p) the cancer cells do not form a tumor in an immune-competent subject;
q) the cancer vaccine triggers cytotoxic T cell-mediated antitumor immunity;
r) the cancer vaccine increases CD4+ T cells and CD8+ T cells in blood and/or tumor microenvironment;
s) the cancer vaccine increases TNFα- and INFγ-secreting CD4+ and CD8+ T cells in blood and/or tumor microenvironment;
t) the cancer vaccine upregulates expression of Icos, Klrc1, Il2rb, Pik3cd, H2-D1, Cc18, Ifng, Icosl, Il2ra, Cxcr3, Ccr7, Cxcl10, Cd74, H2-Ab1, Hspa1b, Cd45, Lifr, and/or Tnf in tumor tissues;
u) the cancer vaccine increases the amount of tumor-infiltrating dendritic cells;
v) the cancer vaccine upregulates CD80, CD103, and/or MHC-II in tumor-associated DCs;
w) the cancer vaccine reduces the number of proliferating cells in a cancer and/or reduces the volume or size of a tumor comprising cancer cells;
x) the cancer vaccine induces a tumor-specific memory T cell response;
y) the cancer vaccine increases the percentages of CD4+ central memory ($T_{CM}$) T cells and/or CD4+ effector memory ($T_{EM}$) T cells in a spleen and/or lymph nodes;
z) the cancer vaccine increases the percentage of splenic CD8+ $T_{CM}$ cells;
aa) the cancer vaccine increases the percentage of CD8+ $T_{EM}$ cells in a spleen and/or lymph nodes;
bb) the cancer vaccine increases the amount of tumor infiltrating CD4+ T cells and/or CD8+ T cells;
cc) the cancer vaccine increases the amount of tumor infiltrating CD4+ $T_{CM}$ cells and/or CD4+ $T_{EM}$ cells;
dd) the cancer vaccine increases the amount of tumor infiltrating CD8+ $T_{CM}$ cells and/or CD8+ $T_{EM}$ cells;
ee) the cancer cells are non-replicative;
ff) the cancer vaccine is administered to a subject in combination with an immunotherapy and/or cancer therapy, optionally wherein the immunotherapy and/or cancer therapy is administered before, after, or concurrently with the cancer vaccine;
gg) the cancer vaccine prevents recurrent and metastatic tumor lesions;
hh) the cancer vaccine is administered to the subject intratumorally or subcutaneously;
ii) the subject is an animal model of the cancer, optionally wherein the animal model is a mouse model; or
jj) the subject is a mammal, optionally wherein the mammal is in remission for a cancer.

3. The cancer vaccine of claim 2, wherein a) the cancer cells are contacted with the TGFβ protein in vitro or ex vivo;
b) the cancer cells are administered to a subject, wherein the TGFβ protein is administered to the subject to thereby contact the cancer cells in vivo, optionally wherein the TGFβ protein is administered before, after, or concurrently with administration of the cancer cells;
c) the cancer vaccine reduces the number of proliferating cells in a cancer and/or reduces the volume or size of a tumor comprising cancer cells at the primary site of immunization;
d) the cancer vaccine reduces the number of proliferating cells in a cancer and/or reduces the volume or size of a tumor comprising cancer cells in a tissue that is distal to the site of immunization;
e) the cancer cells are non-replicative due to irradiation, optionally wherein the irradiation is at a sub-lethal dose;

f) the immunotherapy is cell-based;
g) the immunotherapy comprises a cancer vaccine and/or virus;
h) the immunotherapy inhibits an immune checkpoint, optionally wherein i) the immune checkpoint is selected from the group consisting of CTLA-4, PD-1, VISTA, B7-H2, B7-H3, PD-L1, B7-H4, B7-H6, ICOS, HVEM, PD-L2, CD160, gp49B, PIR-B, KIR family receptors, TIM-1, TIM-3, TIM-4, LAG-3, GITR, 4-IBB, OX-40, BTLA, SIRPalpha (CD47), CD48, 2B4 (CD244), B7.1, B7.2, ILT-2, ILT-4, TIGIT, HHLA2, butyrophilins, and A2aR;
i) the cancer therapy is selected from the group consisting of radiation, a radiosensitizer, and a chemotherapy;
j) the mammal is a mouse or a human; and/or
k) the mammal is a human.

4. A method of preventing reoccurrence of a cancer, and/or treating a cancer in a subject comprising administering to the subject a therapeutically effective amount of a cancer vaccine comprising cancer cells, wherein the cancer cells:
a) lack functional PTEN;
b) lack functional p53; and
c) comprise an activated TGFβ-Smad/p63 signaling pathway by contact with a TGFβ protein, optionally wherein the subject is afflicted with a cancer.

5. The method of claim 4, wherein
a) the TGFβ protein is selected from the group consisting of TGFβ1, TGFβ2, and TGFβ3;
b) the cancer cells are contacted with the TGFβ protein in vitro, in vivo, and/or ex vivo;
c) the cancer cells have increased nuclear localization of Smad2, and/or association of p63 and Smad2 in the nucleus of the cancer cells, relative to cancer cells that have not been contacted with the TGFβ protein;
d) the cancer cells are derived from a solid or hematological cancer;
e) the cancer cells are derived from a cancer cell line;
f) the cancer cells are derived from primary cancer cells;
g) the cancer cells are breast cancer cells;
h) the cancer cells are derived from a triple-negative breast cancer (TNBC);
i) the cancer cells are derived from a cancer that is the same type as the cancer treated with the cancer vaccine;
j) the cancer cells are derived from a cancer that is a different type from the cancer treated with the cancer vaccine;
k) the cancer treated with the cancer vaccine is characterized by loss of PTEN, p53, and/or p110, optionally wherein the cancer further expresses Myc;
l) The cancer treated with the cancer vaccine has functional PTEN and/or p53, optionally wherein the cancer has a Kras activating mutation G12D;
m) the cancer vaccine is syngeneic or xenogeneic to the subject;
n) the cancer vaccine is autologous, matched allogeneic, mismatched allogeneic, or congenic to the subject;
o) the cancer treated with the cancer vaccine is selected from the group consisting of breast tumor, ovarian tumor, or brain tumor;
p) contact with the TGFβ protein induces epithelial-to-mesenchymal (EMT) transition in the cancer cells;
q) contact with the TGFβ protein upregulates the expression levels of ICOSL, PYCARD, SFN, PERP, RIPK3, CASP9, and/or SESN1 in the cancer cells;
r) contact with the TGFβ protein downregulates the expression levels of KSR1, KSR1, EIF4EBP1, ITGA5, EMILIN1, CD200, and/or CSF1 in the cancer cells;
s) the cancer cells are capable of activating co-cultured dendritic cells (DCs) in vitro;
t) the cancer cells are capable of upregulating CD40, CD80, CD86, CD103, CD8, HLA-DR, MHC-II, and/or IL1-β in co-cultured dendritic cells in vitro;
u) the cancer cells are capable of activating co-cultured T cells in the presence of DCs in vitro;
v) the cancer cells are capable of increasing secretion of TNFα and/or IFNγ by co-cultured T cells in the presence of DCs in vitro;
w) the cancer cells do not form a tumor in an immune-competent subject;
x) the cancer vaccine triggers cytotoxic T cell-mediated antitumor immunity;
y) the cancer vaccine increases CD4+ T cells and CD8+ T cells in blood and/or tumor microenvironment;
z) the cancer vaccine increases TNFα- and INFγ-secreting CD4+ and CD8+ T cells in blood and/or tumor microenvironment;
aa) the cancer vaccine upregulates expression of Icos, Klrc1, 112rb, Pik3cd, H2-D1, Ccl8, Ifng, Icosl, Il2ra, Cxcr3, Ccr7, Cxcl10, Cd74, H2-Ab1, Hspa1b, Cd45, Lifr, and/or Tnf in tumor tissues;
bb) the cancer vaccine increases the amount of tumor-infiltrating dendritic cells;
cc) the cancer vaccine upregulates CD80, CD103, and/or MHC-II in tumor-associated DCs;
dd) the cancer vaccine reduces the number of proliferating cells in a cancer and/or reduces the volume or size of a tumor comprising cancer cells;
ee) the cancer vaccine induces a tumor-specific memory T cell response;
ff) the cancer vaccine increases the percentages of CD4+ central memory ($T_{CM}$) T cells and/or CD4+ effector memory ($T_{EM}$) T cells in a spleen and/or lymph nodes;
gg) the cancer vaccine increases the percentage of splenic CD8+ $T_{CM}$ cells;
hh) the cancer vaccine increases the percentage of CD8+ $T_{EM}$ cells in a spleen and/or lymph nodes;
ii) the cancer vaccine increases the amount of tumor infiltrating CD4+ T cells and/or CD8+ T cells;
jj) the cancer vaccine increases the amount of tumor infiltrating CD4+ $T_{CM}$ cells and/or CD4+ $T_{EM}$ cells;
kk) the cancer vaccine increases the amount of tumor infiltrating CD8+ $T_{CM}$ cells and/or CD8+ $T_{EM}$ cells;
ll) the cancer cells are non-replicative;
mm) the method further comprising administering to the subject an immunotherapy and/or cancer therapy, optionally wherein the immunotherapy and/or cancer therapy is administered before, after, or concurrently with the cancer vaccine;
nn) the cancer vaccine is administered in a pharmaceutically acceptable formulation;
oo) the cancer vaccine prevents recurrent and metastatic tumor lesions;
pp) the cancer vaccine is administered to the subject intratumorally or subcutaneously;
qq) the subject is an animal model of the cancer, optionally wherein the animal model is a mouse model; or
rr) the subject is a mammal, optionally wherein the mammal is in remission for a cancer.

6. The method of claim 5, wherein
a) the cancer cells are contacted with the TGFβ protein in vitro or ex vivo;

b) the cancer cells are administered to a subject, wherein the TGFβ protein is administered to the subject to thereby contact the cancer cells in vivo, optionally wherein the TGFβ protein is administered before, after, or concurrently with administration of the cancer cells;

c) the cancer vaccine reduces the number of proliferating cells in a cancer and/or reduces the volume or size of a tumor comprising cancer cells at the primary site of immunization;

d) the cancer vaccine reduces the number of proliferating cells in a cancer and/or reduces the volume or size of a tumor comprising cancer cells in a tissue that is distal to the site of immunization;

e) the cancer cells are non-replicative due to irradiation, optionally wherein the irradiation is at a sub-lethal dose;

f) the immunotherapy is cell-based;

g) the immunotherapy comprises a cancer vaccine and/or virus;

h) the immunotherapy inhibits an immune checkpoint, optionally wherein i) the immune checkpoint is selected from the group consisting of CTLA-4, PD-1, VISTA, B7-H2, B7-H3, PD-L1, B7-H4, B7-H6, ICOS, HVEM, PD-L2, CD160, gp49B, PIR-B, KIR family receptors, TIM-1, TIM-3, TIM-4, LAG-3, GITR, 4-IBB, OX-40, BTLA, SIRPalpha (CD47), CD48, 2B4 (CD244), B7.1, B7.2, ILT-2, ILT-4, TIGIT, HHLA2, butyrophilins, and A2aR;

i) the cancer therapy is selected from the group consisting of radiation, a radiosensitizer, and a chemotherapy;

j) the mammal is a mouse or a human; and/or k) the mammal is a human.

7. A method of assessing the efficacy of the cancer vaccine of claim 1 for treating a subject afflicted with a cancer, comprising:

a) detecting in a subject sample at a first point in time the number of proliferating cells in the cancer and/or the volume or size of a tumor;

b) repeating step a) during at least one subsequent point in time after administration of the cancer vaccine; and c) comparing the number of proliferating cells in the cancer and/or the volume or size of a tumor detected in steps a) and b), wherein the absence of, or a significant decrease in number of proliferating cells in the cancer and/or the volume or size of a tumor in the subsequent sample as compared to the number and/or the volume or size in the sample at the first point in time, indicates that the cancer vaccine treats cancer in the subject.

8. The method of claim 7, wherein a) between the first point in time and the subsequent point in time, the subject has undergone treatment, completed treatment, and/or is in remission for the cancer;

b) the first and/or at least one subsequent sample is selected from the group consisting of ex vivo and in vivo samples;

c) the first and/or at least one subsequent sample is a portion of a single sample or pooled samples obtained from the subject;

d) the first and/or at least one subsequent sample comprises cells, serum, peripheral lymphoid organs, and/or intratumoral tissue obtained from the subject;

e) the method further comprisies determining responsiveness to the agent by measuring at least one criteria selected from the group consisting of clinical benefit rate, survival until mortality, pathological complete response, semi-quantitative measures of pathologic response, clinical complete remission, clinical partial remission, clinical stable disease, recurrence-free survival, metastasis free survival, disease free survival, circulating tumor cell decrease, circulating marker response, and RECIST criteria;

f) the cancer vaccine is administered in a pharmaceutically acceptable formulation;

g) the cancer vaccine prevents recurrent and metastatic tumor lesions;

h) the cancer vaccine is administered to the subject intratumorally or subcutaneously;

i) the subject is an animal model of the cancer, optionally wherein the animal model is a mouse model; and/or j) the subject is a mammal, optionally wherein the mammal is in remission for a cancer.

9. The method of claim 8, wherein the mammal is a mouse or a human.

10. The cancer vaccine of claim 1, wherein the TGFβ protein is TGFβ1.

11. The method of claim 4, wherein the TGFβ protein is TGFβ1.

* * * * *